(12) United States Patent
Raitano et al.

(10) Patent No.: US 7,622,569 B2
(45) Date of Patent: Nov. 24, 2009

(54) NUCLEIC ACID AND CORRESPONDING PROTEIN ENTITLED 98P4B6 USEFUL IN TREATMENT AND DETECTION OF CANCER

(75) Inventors: Arthur B. Raitano, Los Angeles, CA (US); Wangmao Ge, Culver City, CA (US); Aya Jakobovits, Beverly Hills, CA (US); Pia M. Challita-Eid, Encino, CA (US); Mary Faris, Los Angeles, CA (US)

(73) Assignee: Agensys, Inc., Santa Monica, CA (US)

( * ) Notice: Subject to any disclaimer, the term of this patent is extended or adjusted under 35 U.S.C. 154(b) by 0 days.

(21) Appl. No.: 11/588,203

(22) Filed: Oct. 25, 2006

(65) Prior Publication Data

US 2007/0253900 A1    Nov. 1, 2007

Related U.S. Application Data

(63) Continuation of application No. 10/407,484, filed on Apr. 4, 2003, which is a continuation-in-part of application No. 09/455,486, filed on Dec. 6, 1999, now Pat. No. 6,833,438, which is a continuation-in-part of application No. 09/323,873, filed on Jun. 1, 1999, now Pat. No. 6,329,503.

(60) Provisional application No. 60/091,183, filed on Jun. 30, 1998, provisional application No. 60/087,520, filed on Jun. 1, 1998, provisional application No. 60/370,387, filed on Apr. 15, 2002, provisional application No. 60/435,480, filed on Dec. 20, 2002, provisional application No. 60/296,656, filed on Jun. 6, 2001.

(51) Int. Cl.
    *C07H 21/04* (2006.01)
(52) U.S. Cl. ................................... 536/23.53
(58) Field of Classification Search ................. 536/23.1
    See application file for complete search history.

(56) References Cited

U.S. PATENT DOCUMENTS

| | | | |
|---|---|---|---|
| 5,693,762 A * | 12/1997 | Queen et al. | 530/387.3 |
| 6,048,970 A | 4/2000 | Lal et al. | 536/23.6 |
| 6,329,503 B1 * | 12/2001 | Afar et al. | 530/350 |
| 6,833,438 B1 * | 12/2004 | Afar et al. | 530/350 |
| 2002/0022248 A1 | 2/2002 | Xu et al. | 435/69.1 |
| 2002/0146692 A1 | 10/2002 | Yamazaki et al. | 435/6 |
| 2002/0192763 A1 | 12/2002 | Xu et al. | 435/69.7 |
| 2003/0045682 A1 | 3/2003 | Afar et al. | |
| 2003/0060612 A1 | 3/2003 | Goddard et al. | 536/32.1 |
| 2003/0064397 A1 | 4/2003 | Spancake et al. | 435/6 |
| 2003/0100540 A1 | 5/2003 | Zhang et al. | 514/165 |

FOREIGN PATENT DOCUMENTS

| EP | 0834563 | 4/1998 |
|---|---|---|
| EP | 1308459 | 5/2003 |
| WO | WO 94/09150 | 4/1994 |
| WO | WO 95/14772 | 6/1995 |
| WO | WO 98/18489 | 5/1998 |
| WO | WO 98/37093 | 8/1998 |
| WO | WO 98/37418 | 8/1998 |
| WO | WO 98/53071 | 11/1998 |
| WO | WO 99/06548 | 2/1999 |
| WO | WO 99/06550 | 2/1999 |
| WO | WO 99/61469 | 2/1999 |
| WO | WO 99/62941 | 12/1999 |
| WO | WO 00/04149 | 1/2000 |
| WO | WO 00/35937 | 6/2000 |
| WO | WO 01/12662 | 2/2001 |
| WO | WO 01/40276 | 6/2001 |
| WO | WO 01/72962 | 10/2001 |
| WO | WO 02/16429 | 2/2002 |
| WO | WO 02/26822 | 4/2002 |
| WO | WO 02/57303 | 7/2002 |
| WO | WO 02/059260 | 8/2002 |
| WO | WO 02/095010 | 11/2002 |
| WO | WO 02/102993 | 12/2002 |
| WO | WO 02/102994 | 12/2002 |
| WO | WO 03/004622 | 1/2003 |
| WO | WO 03/009814 | 2/2003 |
| WO | WO 2005/113601 A2 | 12/2005 |
| WO | WO 03/022995 | 3/2006 |
| WO | WO 2006/034488 A2 | 3/2006 |

OTHER PUBLICATIONS

Alberts et al., Molecular Biology of the Cell, 3$^{rd}$ edition (1994) p. 465.
Bellone et al., Immunolgoy Today (1999) 20(10):457-462.
Bowie et al, Science 247:1306-1310 (1990).
Burgess et al., J. Cell Biol. 111:2129-2138 (1990).
Celis et al., J. Clin. Invest. 110:1765-1768 (2002).
Chaux et al., Int. J. Cancer 77:538-542 (1998).
Database EMBL Nucleotide and Protein Sequences, Aug. 25, 1996, XP002128081, AA032221, Hinxton, GB.

(Continued)

*Primary Examiner*—Sean E Aeder
(74) *Attorney, Agent, or Firm*—Atulya Agarwal; Shane M. Popp, J. D., L.L.M.; Ginger R. Dreger

(57) ABSTRACT

A novel gene 098P4B6 (also designated STEAP-2) and its encoded protein, and variants thereof, are described wherein 98P4B6 exhibits tissue specific expression in normal adult tissue, and is aberrantly expressed in the cancers listed in Table I. Consequently, 98P4B6 provides a diagnostic, prognostic, prophylactic and/or therapeutic target for cancer. The 98P4B6 gene or fragment thereof, or its encoded protein, or variants thereof, or a fragment thereof, can be used to elicit a humoral or cellular immune response; antibodies or T cells reactive with 98P4B6 can be used in active or passive immunization.

6 Claims, 115 Drawing Sheets

OTHER PUBLICATIONS

Database EMBL Nucleotide and Protein Sequences, May 13, 1997, XP002128082, AC002064, Hinxton, GB.
Database EMBL Nucleotide and Protein Sequences, Jun. 15, 1998, XP002128084, AC004969 (clone DJ112E10), Hinxton, GB.
Database EMBL, "Human BAC Clone CTB-167B5 form 7q21, complete sequence,", Jun. 17, 1998, XP002173859, AC003991, R. Waterston et al.
Database EMBL Nucleotide and Protein Sequences, May 1, 1999, XP002128083, O95034 (clone RG041D11), Hinxton, GB.
Dermer, Bio/Techology 12:320 (1994).
Diss et al., "Expression of skeletal muscle-type voltage-gated Na+ channel in rat and human prostate cancer cell lines," FEBS Letters 427:5-10 (1998).
Dulcert at al., GENBANK (Accession No. Y11840), National Library of Medicine, Bethesda MD, Feb. 11, 1999.
Falk at al., Nature 351:390-296 (1991).
Fu et al., EMBO Journal 15:4392-4401 (1996).
Greenberg et al., PNAS 92:3439 (1995).
Grimes et al., "Electrophysiological characterization of voltage-gated NA$^+$ current expressed in the highly metastatic Mat-LyLu cell line of rat prostate cancer," Journal of Cellular Physiology 175:50-58 (1998).
Gura, Science 278:1041-1042 (1997).
Gutierrrez et al., "Activation of a Ca$^{2+}$ -permeable cation channel by two different inducers of apoptosis in a human prostatic cancer cell line," Journal of Physiology 517:95-107 (1999).
Haverstick et al., "Inhibition of human prostate cancer proliferation in vitro and in a mouse model by a compound synthesized to block Ca$^{2+}$ entry," Cancer Research pp. 1002-1008 (2000).
Holmes, Exp. Opin. Invest. Drugs 10(3):511-519 (2001).
Hubert et al., PNAS USA 96(25):14523-14528 (1999).
Hunt et al., Science 255:1261-1263 (1992).
Kirkin et al., APMIS 106:665-679 (1998).
Lee et al., I. Immunol. 163:6292-6300 (1999).
Lepple-Weinhues et al., "K+ channels and the intracellular calcium signal in human melanoma cell proliferation," J. Membrane Biol. 151:149-157 (1996).
Lewin, Genes VI, Oxford University Press, Inc. NY, Chapter 29, 1997.
Marino et al., "Association between cell membrane potential and breast cancer," Tumor Biol. 15:82-89 (1994).
McClean et al., Eur. J. of Cancer 29A:2243-2248 (1993).
Muller et al., Mol. Cell. Biol. 11:1785 (1991).
Nie et al., "Inhibition of proliferation of MCF-7 breast cancer cells by a blocker of Ca$^{2+}$ -permeable channel," Celll Calcium 22(2):75-82 (1997).
Pancrazio et al., "Voltage-dependent ion channels in small-cell lung cancer cells," Cancer Research 49:5901-5906 (1989).
Parker et al., J. lmmunol. 152:163-175 (1994).
Peshwa et al., Prostate 36:129-138 (1998).
Queen et al. PNAS 86:10024-10033 (1989).
Rama et al., Biochem J. 318:333-341 (1996).
Roitt et al., Immunolgoy 3$^{rd}$ ed., Mosby, London (1993).
Shantz et al., Int. J. Biochem. Cell Bio. 31:107-122 (1999).
Skryma et al., "Potassium conductance in the androgen-sensitive prostate cancer cell line, LNCaP: involvement in cell proliferation," The Prostate 33:112-122 (1997).
Spitler, Cancer Biotherapy 10:1-3 (1995).
Stewart et al., Genome Res. &:422 (1997).
Walter et al., Nat. Genetics 7:22 (1994).
Xue et al., Prostate 30:73-78 (1997).
Challita-Eid Pia M., et al., "Monoclonal antibodies to six-transmembrane epithelial antigen of the prostate-1 inhibit intercellular communication in vitro and growth of human tumor xenografts in vivo", vol. 67, No. 12, pp. 5798-5805, (2007).
Faris M., et al., "Validation of STEAP-1 as a cell surface cancer therapeutic target", Proceedings of the annual meeting of the American Association for Cancer Research, vol. 43, p. 947, (2002).

\* cited by examiner

Figure 1

98P4B6 SSH sequence of 183 nucleotides. (SEQ ID NO: 1)

```
  1     TTTGCAGCTT TGCAGATACC CAGACTGAGC TGGAACTGGA ATTTGTCTTC CTATTGACTC
 61     TACTTCTTTA AAAGCGGCTG CCCATTACAT TCCTCAGCTG TCCTTGCAGT TAGGTGTACA
121     TGTGACTGAG TGTTGGCCAG TGAGATGAAG TCTCCTCAAA GGAAGGCAGC ATGTGTCCTT
                       181     TTT
```

Figure 2A-1

The cDNA (SEQ ID. NO. : 2) and amino acid sequence (SEQ ID. NO. : 3) of 98P4B6 v.1 clone GTD3. The start methionine is underlined. The open reading frame extends from nucleic acid 355-1719 including the stop codon.

```
   1 ggacgcgtgggcggacgcgtgggttcctcgggccctcggcgccacaagctgtccgggcac
  61 gcagccctagcggcgcgtcgctgccaagccggcctccgcgcgcctccctccttccttct
 121 cccctggctgttcgcgatccagcttgggtaggcggggaagcagctggagtgcgaccgcca
 181 cggcagccaccctgcaaccgccagtcggaggtgcagtccgtaggccctggcccccgggtg
 241 ggccttggggagtcggcgccgctcccgaggagctgcaaggctcgccctgcccggcgtg
   1                                                          M  E
 301 gagggcgcggggggcgcggaggatattcttggtgatcttggaagtgtccgtatcATGGAA
   3 S  I  S  M  M  G  S  P  K  S  L  S  E  T  C  L  P  N  G  I
 361 TCAATCTCTATGATGGGAAGCCCTAAGAGCCTTAGTGAAACTTGTTTACCTAATGGCATA
  23 N  G  I  K  D  A  R  K  V  T  V  G  V  I  G  S  G  D  F  A
 421 AATGGTATCAAAGATGCAAGGAAGGTCACTGTAGGTGTGATTGGAAGTGGAGATTTTGCC
  43 K  S  L  T  I  R  L  I  R  C  G  Y  H  V  V  I  G  S  R  N
 481 AAATCCTTGACCATTCGACTTATTAGATGCGGCTATCATGTGGTCATAGGAAGTAGAAAT
  63 P  K  F  A  S  E  F  F  P  H  V  V  D  V  T  H  H  E  D  A
 541 CCTAAGTTTGCTTCTGAATTTTTTCCTCATGTGGTAGATGTCACTCATCATGAAGATGCT
  83 L  T  K  T  N  I  I  F  V  A  I  H  R  E  H  Y  T  S  L  W
 601 CTCACAAAAACAAATATAATATTTGTTGCTATACACAGAGAACATTATACCTCCCTGTGG
 103 D  L  R  H  L  L  V  G  K  I  L  I  D  V  S  N  N  M  R  I
 661 GACCTGAGACATCTGCTTGTGGGTAAAATCCTGATTGATGTGAGCAATAACATGAGGATA
 123 N  Q  Y  P  E  S  N  A  E  Y  L  A  S  L  F  P  D  S  L  I
 721 AACCAGTACCCAGAATCCAATGCTGAATATTTGGCTTCATTATTCCCAGATTCTTTGATT
 143 V  K  G  F  N  V  V  S  A  W  A  L  Q  L  G  P  K  D  A  S
 781 GTCAAAGGATTTAATGTTGTCTCAGCTTGGGCACTTCAGTTAGGACCTAAGGATGCCAGC
 163 R  Q  V  Y  I  C  S  N  N  I  Q  A  R  Q  Q  V  I  E  L  A
 841 CGGCAGGTTTATATATGCAGCAACAATATTCAAGCGCGACAACAGGTTATTGAACTTGCC
 183 R  Q  L  N  F  I  P  I  D  L  G  S  L  S  S  A  R  E  I  E
 901 CGCCAGTTGAATTTCATTCCCATTGACTTGGGATCCTTATCATCAGCCAGAGAGATTGAA
 203 N  L  P  R  L  F  T  L  W  R  G  P  V  V  V  A  I  S  L
 961 AATTTACCCCTACGACTCTTTACTCTCTGGAGAGGGCCAGTGGTGGTAGCTATAAGCTTG
 223 A  T  F  F  L  Y  S  F  V  R  D  V  I  H  P  Y  A  R  N
1021 GCCACATTTTTTTTCCTTTATTCCTTTGTCAGAGATGTGATTCATCCATATGCTAGAAAC
 243 Q  Q  S  D  F  Y  K  I  P  I  E  I  V  N  K  T  L  P  I  V
1081 CAACAGAGTGACTTTTACAAAATTCCTATAGAGATTGTGAATAAAACCTTACCTATAGTT
 263 A  I  T  L  L  S  L  V  Y  L  A  G  L  L  A  A  A  Y  Q  L
1141 GCCATTACTTTGCTCTCCCTAGTATACCTTGCAGGTCTTCTGGCAGCTGCTTATCAACTT
 283 Y  Y  G  T  K  Y  R  R  F  P  P  W  L  E  T  W  L  Q  C  R
```

Figure 2A-2

```
1201 TATTACGGCACCAAGTATAGGAGATTTCCACCTTGGTTGGAAACCTGGTTACAGTGTAGA
 303 K   Q   L   G   L   L   S   F   F   F   A   M   V   H   A   Y   S   L   C
1261 AAACAGCTTGGATTACTAAGTTTTTTCTTCGCTATGGTCCATGTTGCCTACAGCCTCTGC
 323 L   P   M   R   R   S   E   R   Y   L   F   L   N   M   A   Y   Q   Q   V   H
1321 TTACCGATGAGAAGGTCAGAGAGATATTTGTTTCTCAACATGGCTTATCAGCAGGTTCAT
 343 A   N   I   E   N   S   W   N   E   E   V   W   R   I   E   M   Y   I   S
1381 GCAAATATTGAAAACTCTTGGAATGAGGAAGAAGTTTGGAGAATTGAAATGTATATCTCC
 363 F   G   I   M   S   L   G   L   L   S   L   L   A   V   T   S   I   P   S   V
1441 TTTGGCATAATGAGCCTTGGCTTACTTTCCCTCCTGGCAGTCACTTCTATCCCTTCAGTG
 383 S   N   A   L   N   W   R   E   F   S   F   I   Q   S   T   L   G   Y   V   A
1501 AGCAATGCTTTAAACTGGAGAGAATTCAGTTTTATTCAGTCTACACTTGGATATGTCGCT
 403 L   L   I   S   T   F   H   V   L   I   Y   G   W   K   R   A   F   E   E   E
1561 CTGCTCATAAGTACTTTCCATGTTTTAATTTATGGATGGAAACGAGCTTTTGAGGAAGAG
 423 Y   Y   R   F   Y   T   P   P   N   F   V   L   A   L   V   L   P   S   I   V
1621 TACTACAGATTTTATACACCACCAAACTTTGTTCTTGCTCTTGTTTTGCCCTCAATTGTA
 443 I   L   D   L   L   Q   L   C   R   Y   P   D   *
1681 ATTCTGGATCTTTTGCAGCTTTGCAGATACCCAGACTGAgctggaactggaatttgtctt
1741 cctattgactctacttctttaaaagcggctgcccattacattcctcagctgtccttgcag
1801 ttaggtgtacatgtgactgagtgttggccagtgagatgaagtctcctcaaaggaaggcag
1861 catgtgtcctttttcatcccttcatcttgctgctgggattgtggatataacaggagccct
1921 ggcagctgtctccagaggatcaaagccacacccaaagagtaaggcagattagagaccaga
1981 aagaccttgactacttccctacttccactgcttttcctgcatttaagccattgtaaatct
2041 gggtgtgttacatgaagtgaaaattaattctttctgcccttcagttctttatcctgatac
2101 catttaacactgtctgaattaactagactgcaataattctttcttttgaaagcttttaaa
2161 ggataatgtgcaattcacattaaaattgattttccattgtcaattagttatactcatttt
2221 cctgccttgatctttcattagatattttgtatctgcttggaatatattatcttcttttta
2281 actgtgtaattggtaattactaaaactctgtaatctccaaaatattgctatcaaattaca
2341 caccatgttttctatcattctcatagatctgccttataaacatttaaataaaaagtacta
2401 tttaatgatttaaaaaaaaaaaaaaaaaaaaaaaaaaaaaaaaaaaaaaa
```

Figure 2B-1

The cDNA (SEQ ID. NO.: 4) and amino acid sequence (SEQ ID. NO.: 5) of 98P4B6 v.2. The open reading frame extends from nucleic acid 4-138 including the stop codon.

```
  1     G  S  P  G  L  Q  A  L  S  L  S  L  S  S  G  F  T  P  F
  1   agtGGATCCCCCGGGCTGCAGGCTCTCTCTCTCTCTCTCTTCCGGGTTCACGCCATTC
 20   S  C  L  S  L  P  S  S  W  D  Y  R  C  P  P  P  C  P  A  D
 61   TCCTGCCTCAGCCTCCCGAGTAGCTGGGACTACAGGTGCCCGCCACCATGCCCGGCTGAT
 40   F  F  L  Y  F  *
121   TTCTTTTTGTATTTTTAGtacagacggagtttcaccgtgttagccaggatggtctcgatc
181   tcctgacctcgtgatccgcccgccttggcctccaaagtgctgggattacaggtgtgagct
241   accgcgcccggcctattatcttgtactttctaactgagccctctattttctttattttaa
301   taatatttctccccacttgagaatcacttgttagttcttggtaggaattcagttgggcaa
361   tgataactttatgggcaaaaacattctattatagtgaacaaatgaaaataacagcgtat
421   tttcaatattttcttattccttaaattccactcttttaacactatgcttaaccacttaat
481   gtgatgaaatattcctaaaagttaaatgactattaaagcatatattgttgcatgtatata
541   ttaagtagccgatactctaaataaaaataccactgttacagataaatggggcctttaaaa
601   atatgaaaaacaaacttgtgaaaatgtataaaagatgcatctgttgtttcaaatggcact
661   atcttcttttcagtactacaaaaacagaataattttgaagttttagaataaatgtaatat
721   atttactataattctaaatgtttaaatgcttttctaaaaatgcaaaactatgatgtttag
781   ttgctttattttacctctatgtgattattttcttaattgttattttttataatcattat
841   ttttctgaaccattcttctggcctcagaagtaggactgaattctactattgctaggtgtg
901   agaaagtggtggtgagaaccttagagcagtggagatttgctacctggtctgtgttttgag
961   aagtgccccttagaaagttaaaagaatgtagaaaagatactcagtcttaatcctatgcaa
1021  aaaaaaaatcaagtaattgttttcctatgaggaaaataaccatgagctgtatcatgctac
1081  ttagcttttatgtaaatatttcttatgtctcctctattaagagtatttaaaatcatattt
1141  aaatatgaatctattcatgctaacattattttttcaaaacatacatggaaatttagcccag
1201  attgtctacatataaggttttttatttgaattgtaaaatatttaaaagtatgaataaaata
1261  tatttataggtatttatcagagatgattattttgtgctacatacaggttggctaatgagc
1321  tctagtgttaaactacctgattaatttcttataaagcagcataaccttggcttgattaag
1381  gaattctactttcaaaaattaatctgataatagtaacaaggtatattatactttcattac
1441  aatcaaattatagaaattacttgtgtaaaagggcttcaagaatatatccaattttaaat
1501  attttaatatatctcctatctgataacttaattcttctaaattaccacttgccattaagc
1561  tatttcataataaattctgtacagtttccccaaaaaaagagatttatttatgaaatatt
1621  taaagtttctaatgtggtatttaaataaagtatcataaatgtaataagtaaatatttat
1681  ttaggaatactgtgaacactgaactaattattcctgtgtcagtctatgaaatccctgttt
1741  tgaaataagtaaacagcctaaaatgtgttgaattattttgtaaatccatgacttaaaac
1801  aagatacatacatagtataacacacctcacagtgttaagatttatattgtgaaatgagac
1861  accctaccttcaattgttcatcagtgggtaaaacaaattctgatgtacattcaggacaaa
1921  tgattagccctaaatgaaactgtaataatttcagtggaaactcaatctgttttttacctt
1981  aaacagtgaattttacatgaatgaatgggttcttcacttttttttttagtatgagaaatt
```

Figure 2B-2

```
2041 atacagtgcttaattttcagagattctttccatatgttactaaaaaatgttttgttcagc
2101 ctaacatactgagttttttttaactttctaaattattgaatttccatcatgcattcatcc
2161 aaaattaaggcagactgtttggattcttccagtggccagatgagctaaattaaatcacaa
2221 aagcagatgcttttgtatgatctccaaattgccaactttaaggaaatattctcttgaaat
2281 tgtctttaaagatcttttgcagctttgcagatacccagactgagctggaactggaatttg
2341 tcttcctattgactctacttctttaaaagcggctgcccattacattcctcagctgtcctt
2401 gcagttaggtgtacatgtgactgagtgttggccagtgagatgaagtctcctcaaaggaag
2461 gcagcatgtgtccttttcatcccttcatcttgctgctgggattgtggatataacaggag
2521 ccctggcagctgtctccagaggatcaaagccacacccaaagagtaaggcagattagagac
2581 cagaaagaccttgactacttccctacttccactgcttttcctgcatttaagccattgta
2641 aatctgggtgtgttacatgaagtgaaaattaattctttctgcccttcagttctttatcct
2701 gataccatttaacactgtctgaattaactagactgcaataattctttcttttgaaagctt
2761 ttaaaggataatgtgcaattcacattaaaattgattttccattgtcaattagttatactc
2821 attttcctgccttgatctttcattagatattttgtatctgcttggaatatattatcttct
2881 ttttaactgtgtaattggtaattactaaaactctgtaatctccaaaatattgctatcaaa
2941 ttacaccatgttttctatcattctcatagatctgccttataaacatttaaataaaaag
3001 tactatttaatgatttaaaaaaaaaaaaaaaaaaaaaaaa
```

Figure 2C-1

The cDNA (SEQ ID. NO.: 6) and amino acid sequence (SEQ ID. NO.: 7) of 98P4B6 v.3. The start methionine is underlined. The open reading frame extends from nucleic acid 188-1552 including the stop codon.

```
  1  ttctgctatagagatggaacagtatatggaaagctcccaagaaagtgaagagaggaaatt
 61  ggaaaattgtgagtggaccttctgatactgctcctccttgcgtggaaaaggggaaagaac
121  tgcatgcatattattcagcgtcctatattcaaaggatattcttggtgatcttggaagtgt
  1           M   E   S   I   S   M   M   G   S   P   K   S   L   S   E   T   C   L
181  ccgtatcATGGAATCAATCTCTATGATGGGAAGCCCTAAGAGCCTTAGTGAAACTTGTTT
 19   P   N   G   I   N   G   I   K   D   A   R   K   V   T   V   G   V   I   G   S
241  ACCTAATGGCATAAATGGTATCAAAGATGCAAGGAAGGTCACTGTAGGTGTGATTGGAAG
 39   G   D   F   A   K   S   L   T   I   R   L   I   R   C   G   Y   H   V   V   I
301  TGGAGATTTTGCCAAATCCTTGACCATTCGACTTATTAGATGCGGCTATCATGTGGTCAT
 59   G   S   R   N   P   K   F   A   S   E   F   F   P   H   V   V   D   V   T   H
361  AGGAAGTAGAAATCCTAAGTTTGCTTCTGAATTTTTTCCTCATGTGGTAGATGTCACTCA
 79   H   E   D   A   L   T   K   T   N   I   I   F   V   A   I   H   R   E   H   Y
421  TCATGAAGATGCTCTCACAAAAACAAATATAATATTTGTTGCTATACACAGAGAACATTA
 99   T   S   L   W   D   L   R   H   L   L   V   G   K   I   L   I   D   V   S   N
481  TACCTCCCTGTGGGACCTGAGACATCTGCTTGTGGGTAAAATCCTGATTGATGTGAGCAA
119   N   M   R   I   N   Q   Y   P   E   S   N   A   E   Y   L   A   S   L   F   P
541  TAACATGAGGATAAACCAGTACCCAGAATCCAATGCTGAATATTTGGCTTCATTATTCCC
139   D   S   L   I   V   K   G   F   N   V   V   S   A   W   A   L   Q   L   G   P
601  AGATTCTTTGATTGTCAAAGGATTTAATGTTGTCTCAGCTTGGGCACTTCAGTTAGGACC
159   K   D   A   S   R   Q   V   Y   I   C   S   N   N   I   Q   A   R   Q   Q   V
661  TAAGGATGCCAGCCGGCAGGTTTATATATGCAGCAACAATATTCAAGCGCGACAACAGGT
179   I   E   L   A   R   Q   L   N   F   I   P   I   D   L   G   S   L   S   S   A
721  TATTGAACTTGCCCGCCAGTTGAATTTCATTCCCATTGACTTGGGATCCTTATCATCAGC
199   R   E   I   E   N   L   P   L   R   L   F   T   L   W   R   G   P   V   V   V
781  CAGAGAGATTGAAAATTTACCCCTACGACTCTTTACTCTCTGGAGAGGGCCAGTGGTGGT
219   A   I   S   L   A   T   F   F   F   L   Y   S   F   V   R   D   V   I   H   P
841  AGCTATAAGCTTGGCCACATTTTTTTTCCTTTATTCCTTTGTCAGAGATGTGATTCATCC
239   Y   A   R   N   Q   Q   S   D   F   Y   K   I   P   I   E   I   V   N   K   T
901  ATATGCTAGAAACCAACAGAGTGACTTTTACAAAATTCCTATAGAGATTGTGAATAAAAC
259   L   P   I   V   A   I   T   L   L   S   L   V   Y   L   A   G   L   L   A   A
961  CTTACCTATAGTTGCCATTACTTTGCTCTCCCTAGTATACCTTGCAGGTCTTCTGGCAGC
279   A   Y   Q   L   Y   Y   G   T   K   Y   R   R   F   P   P   W   L   E   T   W
1021 TGCTTATCAACTTTATTACGGCACCAAGTATAGGAGATTTCCACCTTGGTTGGAAACCTG
299   L   Q   C   R   K   Q   L   G   L   L   S   F   F   F   A   M   V   H   V   A
1081 GTTACAGTGTAGAAAACAGCTTGGATTACTAAGTTTTTTCTTCGCTATGGTCCATGTTGC
319   Y   S   L   C   L   P   M   R   R   S   E   R   Y   L   F   L   N   M   A   Y
```

Figure 2C-2

```
1141 CTACAGCCTCTGCTTACCGATGAGAAGGTCAGAGAGATATTTGTTTCTCAACATGGCTTA
 339   Q  Q  V  H  A  N  I  E  N  S  W  N  E  E  E  V  W  R  I  E
1201 TCAGCAGGTTCATGCAAATATTGAAAACTCTTGGAATGAGGAAGAAGTTTGGAGAATTGA
 359   M  Y  I  S  F  G  I  M  S  L  G  L  L  S  L  L  A  V  T  S
1261 AATGTATATCTCCTTTGGCATAATGAGCCTTGGCTTACTTTCCCTCCTGGCAGTCACTTC
 379   I  P  S  V  S  N  A  L  N  W  R  E  F  S  F  I  Q  S  T  L
1321 TATCCCTTCAGTGAGCAATGCTTTAAACTGGAGAGAATTCAGTTTTATTCAGTCTACACT
 399   G  Y  V  A  L  L  I  S  T  F  H  V  L  I  Y  G  W  K  R  A
1381 TGGATATGTCGCTCTGCTCATAAGTACTTTCCATGTTTTAATTTATGGATGGAAACGAGC
 419   F  E  E  Y  Y  R  F  Y  T  P  P  N  F  V  L  A  L  V  L
1441 TTTTGAGGAAGAGTACTACAGATTTTATACACCACCAAACTTTGTTCTTGCTCTTGTTTT
 439   P  S  I  V  I  L  D  L  L  Q  L  C  R  Y  P  D  *
1501 GCCCTCAATTGTAATTCTGGATCTTTTGCAGCTTTGCAGATACCCAGACTGAgctggaac
1561 tggaatttgtcttcctattgactctacttctttaaaagcggctgcccattacattcctca
1621 gctgtccttgcagttaggtgtacatgtgactgagtgttggccagtgagatgaagtctcct
1681 caaaggaaggcagcatgtgtccttttcatcccttcatcttgctgctgggattgtggata
1741 taacaggagccctggcagctgtctccagaggatcaaagccacacccaaagagtaaggcag
1801 attagagaccagaaagaccttgactacttccctacttccactgcttttcctgcatttaa
1861 gccattgtaaatctgggtgtgttacatgaagtgaaaattaattctttctgcccttcagtt
1921 ctttatcctgataccatttaacactgtctgaattaactagactgcaataattctttcttt
1981 tgaaagcttttaaaggataatgtgcaattcacattaaaattgattttccattgtcaatta
2041 gttatactcatttcctgccttgatctttcattagatattttgtatctgcttggaatata
2101 ttatcttcttttttaactgtgtaattggtaattactaaaactctgtaatctccaaaatatt
2161 gctatcaaattacacaccatgttttctatcattctcatagatctgccttataaacattta
2221 aataaaaagtactatttaatgatttaacttctgttttgaaaaaaaaaaaaaaaaaaaaaa
```

Figure 2D-1

The cDNA (SEQ ID. NO. : 8) and amino acid sequence (SEQ ID. NO. : 9) of 98P4B6 v.4. The start methionine is underlined. The open reading frame extends from nucleic acid 318-1682 including the stop codon.

```
   1 cccacgcgtccgcggacgcgtgggcggacgcgtgggttcctcgggccctcggcgccacaa
  61 gctgtccgggcacgcagcccctagcggcgcgtcgctgccaagccggcctccgcgcgcctc
 121 cctccttccttctccctggctgttcgcgatccagcttgggtaggcggggaagcagctgg
 181 agtgcgaccgccacggcagccaccctgcaaccgccagtcggagagctaagggcaagtcct
 241 gaggttgggcccaggagaaagaaggcaaggagacattgtcccaggatattcttggtgatc
   1                   M   E   S   I   S   M   M   G   S   P   K   S   L   S   E
 301 ttggaagtgtccgtatcATGGAATCAATCTCTATGATGGGAAGCCCTAAGAGCCTTAGTG
  16  T   C   L   P   N   G   I   N   G   I   K   D   A   R   K   V   T   V   G   V
 361 AAACTTGTTTACCTAATGGCATAAATGGTATCAAAGATGCAAGGAAGGTCACTGTAGGTG
  36  I   G   S   G   D   F   A   K   S   L   T   I   R   L   I   R   C   G   Y   H
 421 TGATTGGAAGTGGAGATTTTGCCAAATCCTTGACCATTCGACTTATTAGATGCGGCTATC
  56  V   V   I   G   S   R   N   P   K   F   A   S   E   F   F   P   H   V   V   D
 481 ATGTGGTCATAGGAAGTAGAAATCCTAAGTTTGCTTCTGAATTTTTTCCTCATGTGGTAG
  76  V   T   H   H   E   D   A   L   T   K   N   I   I   F   V   A   I   H   R
 541 ATGTCACTCATCATGAAGATGCTCTCACAAAAACAAATATAATATTTGTTGCTATACACA
  96  E   H   Y   T   S   L   W   D   L   R   H   L   L   V   G   K   I   L   I   D
 601 GAGAACATTATACCTCCCTGTGGGACCTGAGACATCTGCTTGTGGGTAAAATCCTGATTG
 116  V   S   N   N   M   R   I   N   Q   Y   P   E   S   N   A   E   Y   L   A   S
 661 ATGTGAGCAATAACATGAGGATAAACCAGTACCCAGAATCCAATGCTGAATATTTGGCTT
 136  L   F   P   D   S   L   I   V   K   G   F   N   V   V   S   A   W   A   L   Q
 721 CATTATTCCCAGATTCTTTGATTGTCAAAGGATTTAATGTTGTCTCAGCTTGGGCACTTC
 156  L   G   P   K   D   A   S   R   Q   V   Y   I   C   S   N   N   I   Q   A   R
 781 AGTTAGGACCTAAGGATGCCAGCCGGCAGGTTTATATATGCAGCAACAATATTCAAGCGC
 176  Q   Q   V   I   E   L   A   R   Q   L   N   F   I   P   I   D   L   G   S   L
 841 GACAACAGGTTATTGAACTTGCCCGCCAGTTGAATTTCATTCCCATTGACTTGGGATCCT
 196  S   S   A   R   E   I   E   N   L   P   L   R   L   F   T   L   W   R   G   P
 901 TATCATCAGCCAGAGAGATTGAAAATTTACCCCTACGACTCTTTACTCTCTGGAGAGGGC
 216  V   V   V   A   I   S   L   A   T   F   F   F   L   Y   S   F   V   R   D   V
 961 CAGTGGTGGTAGCTATAAGCTTGGCCACATTTTTTTTCCTTTATTCCTTTGTCAGAGATG
 236  I   H   P   Y   A   R   N   Q   Q   S   D   F   Y   K   I   P   I   E   I   V
1021 TGATTCATCCATATGCTAGAAACCAACAGAGTGACTTTTACAAAATTCCTATAGAGATTG
 256  N   K   T   L   P   I   V   A   I   T   L   L   S   L   V   Y   L   A   G   L
1081 TGAATAAAACCTTACCTATAGTTGCCATTACTTTGCTCTCCCTAGTATACCTTGCAGGTC
 276  L   A   A   A   Y   Q   L   Y   Y   G   T   K   Y   R   R   F   P   P   W   L
1141 TTCTGGCAGCTGCTTATCAACTTTATTACGGCACCAAGTATAGGAGATTTCCACCTTGGT
 296  E   T   W   L   Q   C   R   K   Q   L   G   L   L   S   F   F   F   A   M   V
```

Figure 2D-2

```
1201 TGGAAACCTGGTTACAGTGTAGAAAACAGCTTGGATTACTAAGTTTTTTCTTCGCTATGG
 316    H  V  A  Y  S  L  C  L  P  M  R  R  S  E  R  Y  L  F  L  N
1261 TCCATGTTGCCTACAGCCTCTGCTTACCGATGAGAAGGTCAGAGAGATATTTGTTTCTCA
 336    M  A  Y  Q  Q  V  H  A  N  I  E  N  S  W  N  E  E  E  V  W
1321 ACATGGCTTATCAGCAGGTTCATGCAAATATTGAAAACTCTTGGAATGAGGAAGAAGTTT
 356    R  I  E  M  Y  I  S  F  G  I  M  S  L  G  L  L  S  L  L  A
1381 GGAGAATTGAAATGTATATCTCCTTTGGCATAATGAGCCTTGGCTTACTTTCCTCCTGG
 376    V  T  S  I  P  S  V  S  N  A  L  N  W  R  E  F  S  F  I  Q
1441 CAGTCACTTCTATCCCTTCAGTGAGCAATGCTTTAAACTGGAGAGAATTCAGTTTTATTC
 396    S  T  L  G  Y  V  A  L  L  I  S  T  F  H  V  L  I  Y  G  W
1501 AGTCTACACTTGGATATGTCGCTCTGCTCATAAGTACTTTCCATGTTTTAATTTATGGAT
 416    K  R  A  F  E  E  E  Y  Y  R  F  Y  T  P  P  N  F  V  L  A
1561 GGAAACGAGCTTTTGAGGAAGAGTACTACAGATTTTATACACCACCAAACTTTGTTCTTG
 436    L  V  L  P  S  I  V  I  L  D  L  L  Q  L  C  R  Y  P  D  *
1621 CTCTTGTTTTGCCCTCAATTGTAATTCTGGATCTTTTGCAGCTTTGCAGATACCCAGACT
1681 GAgctggaactggaatttgtcttcctattgactctacttctttaaaagcggctgcccatt
1741 acattcctcagctgtccttgcagttaggtgtacatgtgactgagtgttggccagtgagat
1801 gaagtctcctcaaaggaaggcagcatgtgtccttttttcatcccttcatcttgctgctggg
1861 attgtggatataacaggagccctggcagctgtctccagaggatcaaagccacacccaaag
1921 agtaaggcagattagagaccagaaagaccttgactacttccctacttccactgcttttcc
1981 tgcatttaagccattgtaaatctgggtgtgttacatgaagtgaaaattaattctttctgc
2041 ccttcagttctttatcctgataccatttaacactgtctgaattaactagactgcaataat
2101 tctttcttttgaaagcttttaaaggataatgtgcaattcacattaaaattgattttccat
2161 tgtcaattagttatactcatttcctgccttgatctttcattagatatttgtatctgct
2221 tggaatatattatcttcttttttaactgtgtaattggtaattactaaaactctgtaatctc
2281 caaaatattgctatcaaattacacaccatgttttctatcattctcatagatctgccttat
2341 aaacatttaaataaaaagtactatttaatgattt
```

Figure 2E-1 he cDNA (SEQ ID. NO.: 10) and amino acid sequence (SEQ ID. NO.: 11) of 98P4B6 v.5. The start methionine is underlined. The open reading frame extends from nucleic acid 318-1577 including the stop codon.

```
   1 cccacgcgtccgcggacgcgtgggcggacgcgtgggttcctcgggccctcggcgccacaa
  61 gctgtccgggcacgcagccctagcggcgcgtcgctgccaagccggcctccgcgcgcctc
 121 cctccttccttctccccctggctgttcgcgatccagcttgggtaggcggggaagcagctgg
 181 agtgcgaccgctacggcagccaccctgcaaccgccagtcggagagctaagggcaagtcct
 241 gaggttgggcccaggagaaagaaggcaaggagacattgtcccaggatattcttggtgatc
   1                      M  E  S  I  S  M  M  G  S  P  K  S  L  S  E
 301 ttggaagtgtccgtatcATGGAATCAATCTCTATGATGGGAAGCCCTAAGAGCCTTAGTG
  16         T  C  L  P  N  G  I  N  G  I  K  D  A  R  K  V  T  V  G  V
 361 AAACTTGTTTACCTAATGGCATAAATGGTATCAAAGATGCAAGGAAGGTCACTGTAGGTG
  36         I  G  S  G  D  F  A  K  S  L  T  I  R  L  I  R  C  G  Y  H
 421 TGATTGGAAGTGGAGATTTTGCCAAATCCTTGACCATTCGACTTATTAGATGCGGCTATC
  56         V  V  I  G  S  R  N  P  K  F  A  S  E  F  F  P  H  V  V  D
 481 ATGTGGTCATAGGAAGTAGAAATCCTAAGTTTGCTTCTGAATTTTTTCCTCATGTGGTAG
  76         V  T  H  H  E  D  A  L  T  K  T  N  I  I  F  V  A  I  H  R
 541 ATGTCACTCATCATGAAGATGCTCTCACAAAAACAAATATAATATTTGTTGCTATACACA
  96         E  H  Y  T  S  L  W  D  L  R  H  L  L  V  G  K  I  L  I  D
 601 GAGAACATTATACCTCCCTGTGGGACCTGAGACATCTGCTTGTGGGTAAAATCCTGATTG
 116         V  S  N  N  M  R  I  N  Q  Y  P  E  S  N  A  E  Y  L  A  S
 661 ATGTGAGCAATAACATGAGGATAAACCAGTACCCAGAATCCAATGCTGAATATTTGGCTT
 136         L  F  P  D  S  L  I  V  K  G  F  N  V  V  S  A  W  A  L  Q
 721 CATTATTCCCAGATTCTTTGATTGTCAAAGGATTTAATGTTGTCTCAGCTTGGGCACTTC
 156         L  G  P  K  D  A  S  R  Q  V  Y  I  C  S  N  N  I  Q  A  R
 781 AGTTAGGACCTAAGGATGCCAGCCGGCAGGTTTATATATGCAGCAACAATATTCAAGCGC
 176         Q  Q  V  I  E  L  A  R  Q  L  N  F  I  P  I  D  L  G  S  L
 841 GACAACAGGTTATTGAACTTGCCCGCCAGTTGAATTTCATTCCCATTGACTTGGGATCCT
 196         S  S  A  R  E  I  E  N  L  P  L  R  L  F  T  F  W  R  G  P
 901 TATCATCAGCCAGAGAGATTGAAAATTTACCCCTACGACTCTTTACTTTCTGGAGAGGGC
 216         V  V  V  A  I  S  L  A  T  F  F  F  L  Y  S  F  V  R  D  V
 961 CAGTGGTGGTAGCTATAAGCTTGGCCACATTTTTTTTCCTTTATTCCTTTGTCAGAGATG
 236         I  H  P  Y  A  R  N  Q  Q  S  D  F  Y  K  I  P  I  E  I  V
1021 TGATTCATCCATATGCTAGAAACCAACAGAGTGACTTTTACAAAATTCCTATAGAGATTG
 256         N  K  T  L  P  I  V  A  I  T  L  L  S  L  V  Y  L  A  G  L
1081 TGAATAAAACCTTACCTATAGTTGCCATTACTTTGCTCTCCCTAGTATACCTTGCAGGTC
 276         L  A  A  A  Y  Q  L  Y  Y  G  T  K  Y  R  R  F  P  P  W  L
1141 TTCTGGCAGCTGCTTATCAACTTTATTACGGCACCAAGTATAGGAGATTTCCACCTTGGT
 296         E  T  W  L  Q  C  R  K  Q  L  G  L  L  S  F  F  F  A  M  V
```

Figure 2E-2

```
1201 TGGAAACCTGGTTACAGTGTAGAAAACAGCTTGGATTACTAAGTTTTTTCTTCGCTATGG
 316   H   V   A   Y   S   L   C   L   P   M   R   R   S   E   R   Y   L   F   L   N
1261 TCCATGTTGCCTACAGCCTCTGCTTACCGATGAGAAGGTCAGAGAGATATTTGTTTCTCA
 336   M   A   Y   Q   Q   V   H   A   N   I   E   N   S   W   N   E   E   E   V   W
1321 ACATGGCTTATCAGCAGGTTCATGCAAATATTGAAAACTCTTGGAATGAGGAAGAAGTTT
 356   R   I   E   M   Y   I   S   F   G   I   M   S   L   G   L   L   S   L   L   A
1381 GGAGAATTGAAATGTATATCTCCTTTGGCATAATGAGCCTTGGCTTACTTTCCCTCCTGG
 376   V   T   S   I   P   S   V   S   N   A   L   N   W   R   E   F   S   F   I   Q
1441 CAGTCACTTCTATCCCTTCGGTGAGCAATGCTTTAAACTGGAGAGAATTCAGTTTTATTC
 396   I   F   C   S   F   A   D   T   Q   T   E   L   E   L   E   F   V   F   L   L
1501 AGATCTTTTGCAGCTTTGCAGATACCCAGACTGAGCTGGAACTGGAATTTGTCTTCCTAT
 416   T   L   L   L   *
1561 TGACTCTACTTCTTTAAaagcggctgcccattacattcctcagctgtccttgcagttagg
1621 tgtacatgtgactgagtgttggccagtgagatgaagtctcctcaaaggaaggcagcatgt
1681 gtccttttcatcccttcatcttgctgctgggattgtggatataacaggagccctggcag
1741 ctgctccagaggatcaaagccacacccaaagagtaaggcagattagagaccagaaagacc
1801 ttgactacttccctacttccactgcttttcctgcatttaagccattgtaaatctgggtg
1861 tgttacatgaagtgaaaattaattctttctgcccttcagttctttatcctgataccattt
1921 aacactgtctgaattaactagactgcaataattctttcttttgaaagcttttaaaggata
1981 atgtgcaattcacattaaaattgattttccattgtcaattagttatactcattttcctgc
2041 cttgatctttcattagatattttgtatctgcttggaatatattatcttcttttttaactgt
2101 gtaattggtaattactaaaactctgtaatctccaaaatattgctatcaaattacacacca
2161 tgttttctatcattctcatagatctgccttataaacatttaaataaaaagtactatttac
2221 caaaaaaaaaaaaaaaaaaaaaaaaaaaa
```

Figure 2F-1 he cDNA (SEQ ID. NO. : 12) and amino acid sequence (SEQ ID. NO. : 13) of 98P4B6 v.6 clone NP1. The start methionine is underlined. The open reading frame extends from nucleic acid 318-1790 including the stop codon.

```
   1 cccacgcgtccgcggacgcgtgggcggacgcgtgggttcctcgggccctcggcgccacaa
  61 gctgtccgggcacgcagccctagcggcgcgtcgctgccaagccggcctccgcgcgcctc
 121 cctccttccttctccctggctgttcgcgatccagcttgggtaggcggggaagcagctgg
 181 agtgcgaccgccacggcagccaccctgcaaccgccagtcggagagctaagggcaagtcct
 241 gaggttgggcccaggagaaagaaggcaaggagacattgtcccaggatattcttggtgatc
   1                     M  E  S  I  S  M  M  G  S  P  K  S  L  S  E
 301 ttggaagtgtccgtatcATGGAATCAATCTCTATGATGGGAAGCCCTAAGAGCCTTAGTG
  16    T  C  L  P  N  G  I  N  G  I  K  D  A  R  K  V  T  V  G  V
 361 AAACTTGTTTACCTAATGGCATAAATGGTATCAAAGATGCAAGGAAGGTCACTGTAGGTG
  36    I  G  S  G  D  F  A  K  S  L  T  I  R  L  I  R  C  G  Y  H
 421 TGATTGGAAGTGGAGATTTTGCCAAATCCTTGACCATTCGACTTATTAGATGCGGCTATC
  56    V  V  I  G  S  R  N  P  K  F  A  S  E  F  F  P  H  V  V  D
 481 ATGTGGTCATAGGAAGTAGAAATCCTAAGTTTGCTTCTGAATTTTTTCCTCATGTGGTAG
  76    V  T  H  H  E  D  A  L  T  K  T  N  I  I  F  V  A  I  H  R
 541 ATGTCACTCATCATGAAGATGCTCTCACAAAAACAAATATAATATTTGTTGCTATACACA
  96    E  H  Y  T  S  L  W  D  L  R  H  L  L  V  G  K  I  L  I  D
 601 GAGAACATTATACCTCCCTGTGGGACCTGAGACATCTGCTTGTGGGTAAAATCCTGATTG
 116    V  S  N  N  M  R  I  N  Q  Y  P  E  S  N  A  E  Y  L  A  S
 661 ATGTGAGCAATAACATGAGGATAAACCAGTACCCAGAATCCAATGCTGAATATTTGGCTT
 136    L  F  P  D  S  L  I  V  K  G  F  N  V  V  S  A  W  A  L  Q
 721 CATTATTCCCAGATTCTTTGATTGTCAAAGGATTTAATGTTGTCTCAGCTTGGGCACTTC
 156    L  G  P  K  D  A  S  R  Q  V  Y  I  C  S  N  N  I  Q  A  R
 781 AGTTAGGACCTAAGGATGCCAGCCGGCAGGTTTATATATGCAGCAACAATATTCAAGCGC
 176    Q  Q  V  I  E  L  A  R  Q  L  N  F  I  P  I  D  L  G  S  L
 841 GACAACAGGTTATTGAACTTGCCCGCCAGTTGAATTTCATTCCCATTGACTTGGGATCCT
 196    S  S  A  R  E  I  E  N  L  P  L  R  L  F  T  L  W  R  G  P
 901 TATCATCAGCCAGAGAGATTGAAAATTTACCCCTACGACTCTTTACTCTCTGGAGAGGGC
 216    V  V  V  A  I  S  L  A  T  F  F  F  L  Y  S  F  V  R  D  V
 961 CAGTGGTGGTAGCTATAAGCTTGGCCACATTTTTTTTCCTTTATTCCTTTGTCAGAGATG
 236    I  H  P  Y  A  R  N  Q  Q  S  D  F  Y  K  I  P  I  E  I  V
1021 TGATTCATCCATATGCTAGAAACCAACAGAGTGACTTTTACAAAATTCCTATAGAGATTG
 256    N  K  T  L  P  I  V  A  I  T  L  L  S  L  V  Y  L  A  G  L
1081 TGAATAAAACCTTACCTATAGTTGCCATTACTTTGCTCTCCCTAGTATACCTTGCAGGTC
 276    L  A  A  A  Y  Q  L  Y  Y  G  T  K  Y  R  R  F  P  P  W  L
1141 TTCTGGCAGCTGCTTATCAACTTTATTACGGCACCAAGTATAGGAGATTTCCACCTTGGT
 296    E  T  W  L  Q  C  R  K  Q  L  G  L  L  S  F  F  F  A  M  V
```

Figure 2F-2

```
1201 TGGAAACCTGGTTACAGTGTAGAAAACAGCTTGGATTACTAAGTTTTTTCTTCGCTATGG
 316   H  V  A  Y  S  L  C  L  P  M  R  R  S  E  R  Y  L  F  L  N
1261 TCCATGTTGCCTACAGCCTCTGCTTACCGATGAGAAGGTCAGAGAGATATTTGTTTCTCA
 336   M  A  Y  Q  Q  V  H  A  N  I  E  N  S  W  N  E  E  E  V  W
1321 ACATGGCTTATCAGCAGGTTCATGCAAATATTGAAAACTCTTGGAATGAGGAAGAAGTTT
 356   R  I  E  M  Y  I  S  F  G  I  M  S  L  G  L  L  S  L  L  A
1381 GGAGAATTGAAATGTATATCTCCTTTGGCATAATGAGCCTTGGCTTACTTTCCCTCCTGG
 376   V  T  S  I  P  S  V  S  N  A  L  N  W  R  E  F  S  F  I  Q
1441 CAGTCACTTCTATCCCTTCAGTGAGCAATGCTTTAAACTGGAGAGAATTCAGTTTTATTC
 396   S  T  L  G  Y  V  A  L  L  I  S  T  F  H  V  L  I  Y  G  W
1501 AGTCTACACTTGGATATGTCGCTCTGCTCATAAGTACTTTCCATGTTTTAATTTATGGAT
 416   K  R  A  F  E  E  E  Y  Y  R  F  Y  T  P  P  N  F  V  L  A
1561 GGAAACGAGCTTTTGAGGAAGAGTACTACAGATTTTATACACCACCAAACTTTGTTCTTG
 436   L  V  L  P  S  I  V  I  L  G  K  I  I  L  F  L  P  C  I  S
1621 CTCTTGTTTTGCCCTCAATTGTAATTCTGGGTAAGATTATTTTATTCCTTCCATGTATAA
 456   R  K  L  K  R  I  K  K  G  W  E  K  S  Q  F  L  E  E  G  I
1681 GCCGAAAGCTAAAACGAATTAAAAAAGGCTGGAAAAGAGCCAATTTCTGGAAGAAGGTA
 476   G  G  T  I  P  H  V  S  P  E  R  V  T  V  M  *
1741 TTGGAGGAACAATTCCTCATGTCTCCCCGGAGAGGGTCACAGTAATGTGAtgataaatgg
1801 tgttcacagctgccatataaagttctactcatgccattatttttatgacttctacgttca
1861 gttacaagtatgctgtcaaattatcgtgggttgaaacttgttaaatgagatttcaactga
1921 cttagtgatagagttttcttcaagttaattttcacaaatgtcatgtttgccaatatgaat
1981 ttttctagtcaacatattattgtaatttaggtatgttttgttttgttttgcacaactgta
2041 accctgttgttactttatatttcataatcagacaaaaatacttacagttaataatataga
2101 tataatgttaaaaacaatttgcaaaccagcagaattttaagcttttaaaataattcaatg
2161 gatatacatttttttctgaagattaagattttaattattcaacttaaaaagtagaaatgc
2221 attattatacatttttttaagaaaggacacgttatgttagcatctaggtaaggctgcatg
2281 atagcattcctatatttctctcataaaataggatttgaaggatgaaattaattgtatgaa
2341 gcaatgtgattatatgaagagacacaaattaaaaagacaaattaaacctgaaattatatt
2401 taaaatatatttgagacatgaaatacatactgataatacatacctcatgaaagattttat
2461 tctttattgtgttacagagcagtttcattttcatattaatatactgatcaggaagaggat
2521 tcagtaacatttggcttccaaaactgctatctctaatacggtaccaatcctaggaactgt
2581 atactagttcctacttagaacaaaagtatcaagtttgcacacaagtaatctgccagctga
2641 cctttgtcgcaccttaaccagtcaccacttgctatggtataggattatactgatgttctt
2701 tgagggattctgatgtgctaggcatggttctaagtactttacttgtattatcccatttaa
2761 tacttagaacaaccccgtgagataagtagttattatcctcattttacacatgagggaccg
2821 aaggatagaaaagttattttttcaaaggtcttgcagttaataaatggcagagtgagcattc
2881 aagtccaggtagtcatattccagaggccacggttttaaccactaggctctagagctcccg
2941 ccgcgcccctatgcattatgttcacaatgccaatctagatgcttcctcttttgtataaag
```

Figure 2F-3

```
3001 tcactgacattctttagagtgggttgggtgcatccaaaaatgtataaaaatattattata
3061 ataaacttattactgcttgtagggtaattcacagttacttaccctattcttgcttggaac
3121 atgagcctggagacccatggcagtccatatgcctccctatgcagtgaagggccctagcag
3181 tgttaacaaattgctgagatcccacggagtctttcaaaaatctctgtagagttagtcttc
3241 tccttttctcttcctgagaagttctcctgcctgcataaccattcattagggagtacttta
3301 caagcatgaaggatattagggtaagtggctaattataaatctactctagagacatataat
3361 catacagattattcataaaattttttcagtgctgtccttccacatttaattgcattttgct
3421 caaactgtagaatgccctacattcccccaccccaatttgctatttccttattaaaatag
3481 aaaattataggcaagatacaattatatgcgttcctcttcctgaaattataacatttctaa
3541 acttacccacgtagggactactgaatccaactgccaacaataaaaagacttttatttagt
3601 agaggctacctttccccccagtgactcttttctacaactgccttgtcagtttggtaatt
3661 cacttatgattttctaatgttctcttggtgaattttattatcttggaccctcttttttt
3721 tttttttaaagacagagtcttgctctgtcaccca
```

Figure 2G-1

The cDNA (SEQ ID. NO. : 14) and amino acid sequence (SEQ ID. NO. : 15) of 98P4B6 v.7. The start methionine is underlined. The open reading frame extends from nucleic acid 295-2025 including the stop codon.

```
   1 ggagaaaatttacagaaacccagagccaaaggtgctctcaggggatcccctgaaacattc
  61 aaagccattgcggccccagaagcttgggtaggcggggaagcagctggagtgcgaccgccg
 121 cggcagccaccctgcaaccgccagtcggaggtgcagtccgtaggccctggccccggggtg
 181 ggcccttggggagtcggcgccgctcccggggagctgcaaggctcgcccctgccggcgtg
   1                                                           M   E
 241 gagggcgcggggggcgcggaggatattcttggtgatcttggaagtgtccgtatcATGGAA
   3 S   I   S   M   M   G   S   P   K   S   L   S   E   T   F   L   P   N   G   I
 301 TCAATCTCTATGATGGGAAGCCCTAAGAGCCTTAGTGAAACTTTTTTACCTAATGGCATA
  23 N   G   I   K   D   A   R   K   V   T   V   G   V   I   G   S   G   D   F   A
 361 AATGGTATCAAAGATGCAAGGAAGGTCACTGTAGGTGTGATTGGAAGTGGAGATTTTGCC
  43 K   S   L   T   I   R   L   I   R   C   G   Y   H   V   V   I   G   S   R   N
 421 AAATCCTTGACCATTCGACTTATTAGATGCGGCTATCATGTGGTCATAGGAAGTAGAAAT
  63 P   K   F   A   S   E   F   F   P   H   V   V   D   V   T   H   H   E   D   A
 481 CCTAAGTTTGCTTCTGAATTTTTTCCTCATGTGGTAGATGTCACTCATCATGAAGATGCT
  83 L   T   K   T   N   I   I   F   V   A   I   H   R   E   H   Y   T   S   L   W
 541 CTCACAAAAACAAATATAATATTTGTTGCTATACACAGAGAACATTATACCTCCCTGTGG
 103 D   L   R   H   L   L   V   G   K   I   L   I   D   V   S   N   N   M   R   I
 601 GACCTGAGACATCTGCTTGTGGGTAAAATCCTGATTGATGTGAGCAATAACATGAGGATA
 123 N   Q   Y   P   E   S   N   A   E   Y   L   A   S   L   F   P   D   S   L   I
 661 AACCAGTACCCAGAATCCAATGCTGAATATTTGGCTTCATTATTCCCAGATTCTTTGATT
 143 V   K   G   F   N   V   V   S   A   W   A   L   Q   L   G   P   K   D   A   S
 721 GTCAAAGGATTTAATGTTGTCTCAGCTTGGGCACTTCAGTTAGGACCTAAGGATGCCAGC
 163 R   Q   V   Y   I   C   S   N   N   I   Q   A   R   Q   Q   V   I   E   L   A
 781 CGGCAGGTTTATATATGCAGCAACAATATTCAAGCGCGACAACAGGTTATTGAACTTGCC
 183 R   Q   L   N   F   I   P   I   D   L   G   S   L   S   S   A   R   E   I   E
 841 CGCCAGTTGAATTTCATTCCCATTGACTTGGGATCCTTATCATCAGCCAGAGAGATTGAA
 203 N   L   P   L   R   L   F   T   L   W   R   G   P   V   V   V   A   I   S   L
 901 AATTTACCCCTACGACTCTTTACTCTCTGGAGAGGGCCAGTGGTGGTAGCTATAAGCTTG
 223 A   T   F   F   L   Y   S   F   V   R   D   V   I   H   P   Y   A   R   N
 961 GCCACATTTTTTTTCCTTTATTCCTTTGTCAGAGATGTGATTCATCCATATGCTAGAAAC
 243 Q   Q   S   D   F   Y   K   I   P   I   E   I   V   N   K   T   L   P   I   V
1021 CAACAGAGTGACTTTTACAAAATTCCTATAGAGATTGTGAATAAAACCTTACCTATAGTT
 263 A   I   T   L   L   S   L   V   Y   L   A   G   L   L   A   A   A   Y   Q   L
1081 GCCATTACTTTGCTCTCCCTAGTATACCTCGCAGGTCTTCTGGCAGCTGCTTATCAACTT
 283 Y   Y   G   T   K   Y   R   R   F   P   P   W   L   E   T   W   L   Q   C   R
1141 TATTACGGCACCAAGTATAGGAGATTTCCACCTTGGTTGGAAACCTGGTTACAGTGTAGA
 303 K   Q   L   G   L   L   S   F   F   F   A   M   V   H   V   A   Y   S   L   C
```

Figure 2G-2

```
1201 AAACAGCTTGGATTACTAAGTTTTTTCTTCGCTATGGTCCATGTTGCCTACAGCCTCTGC
 323 L   P   M   R   R   S   E   R   Y   L   F   L   N   M   A   Y   Q   Q   S   T
1261 TTACCGATGAGAAGGTCAGAGAGATATTTGTTTCTCAACATGGCTTATCAGCAGTCTACA
 343 L   G   Y   V   A   L   L   I   S   T   F   H   V   L   I   Y   G   W   K   R
1321 CTTGGATATGTCGCTCTGCTCATAAGTACTTTCCATGTTTTAATTTATGGATGGAAACGA
 363 A   F   E   E   E   Y   Y   R   F   Y   T   P   P   N   F   V   L   A   L   V
1381 GCTTTTGAGGAAGAGTACTACAGATTTTATACACCACCAAACTTTGTTCTTGCTCTTGTT
 383 L   P   S   I   V   I   L   D   L   S   V   E   V   L   A   S   P   A   A   A
1441 TTGCCCTCAATTGTAATTCTGGATCTGTCTGTGGAGGTTCTGGCTTCCCCAGCTGCTGCC
 403 W   K   C   L   G   A   N   I   L   R   G   G   L   S   E   I   V   L   P   I
1501 TGGAAATGCTTAGGTGCTAATATCCTGAGAGGAGGATTGTCAGAGATAGTACTCCCCATA
 423 E   W   Q   Q   D   R   K   I   P   P   L   S   T   P   P   P   P   A   M   W
1561 GAGTGGCAGCAGGACAGGAAGATCCCCCCACTCTCCACCCCGCCGCCACCGGCCATGTGG
 443 T   E   E   A   G   A   T   A   E   A   Q   E   S   G   I   R   N   K   S   S
1621 ACAGAGGAAGCCGGGGCGACCGCCGAGGCCCAGGAATCCGGCATCAGGAACAAGTCTAGC
 463 S   S   S   Q   I   P   V   V   G   V   V   T   E   D   D   E   A   Q   D   S
1681 AGTTCCAGTCAAATCCCGGTGGTTGGGGTGGTGACGGAGGACGATGAGGCGCAGGATTCC
 483 I   D   P   P   E   S   P   D   R   A   L   K   A   A   N   S   W   R   N   P
1741 ATTGATCCCCCAGAGAGCCCTGATCGTGCCTTAAAAGCCGCGAATTCCTGGAGGAACCCT
 503 V   L   P   H   T   N   G   V   G   P   L   W   E   F   L   L   R   L   L   K
1801 GTCCTGCCTCACACTAATGGTGTGGGGCCACTGTGGGAATTCCTGTTGAGGCTTCTCAAA
 523 S   Q   A   A   S   G   T   L   S   L   A   F   T   S   W   S   L   G   E   F
1861 TCTCAGGCTGCGTCAGGAACCCTGTCTCTTGCGTTCACATCCTGGAGCCTTGGAGAGTTC
 543 L   G   S   G   T   W   M   K   L   E   T   I   I   L   S   K   L   T   Q   E
1921 CTTGGGAGTGGGACATGGATGAAGCTGGAAACCATAATTCTCAGCAAACTAACACAGGAA
 563 Q   K   S   K   H   C   M   F   S   L   I   S   G   S   *
1981 CAGAAATCCAAACACTGCATGTTCTCACTGATAAGTGGGAGTTGAacaatgagaacacat
2041 ggacacagggaggggaacgtcacacaccagggcctgtcgggggtgggaggcctagcaatt
2101 cattagaattacctgtgaagcttttaaaatgtaaggtttggatggaatgctcagaccta
2161 ccttagacccaattaagcccacagctttgagg
```

Figure 2H-1

The cDNA (SEQ ID. NO. : 16) and amino acid sequence (SEQ ID. NO. : 17) of 98P4B6 v.8. The start methionine is underlined. The open reading frame extends from nucleic acid 394-1866 including the stop codon.

```
   1 gccccctccgagctccccgactcctccccgcgctccacggctcttcccgactccagtcag
  61 cgttcctcgggccctcggcgccacaagctgtccgggcacgcagcccctagcggcgcgtcg
 121 ctgccaagccggcctccgcgcgcctccctccttccttctccccctggctgttcgcgatcca
 181 gcttgggtaggcggggaagcagctggagtgcgaccgccacggcagccaccctgcaaccgc
 241 cagtcggaggtgcagtccgtaggccctggccccgggtgggcccttggggagtcggcgcc
 301 gctcccgaggagctgcaaggctcgcccctgcccggcgtggagggcgcggggggcgcggag
   1                                           M  E  S  I  S  M  M  G  S
 361 gatattcttggtgatcttggaagtgtccgtatcATGGAATCAATCTCTATGATGGGAAGC
  10 P  K  S  L  S  E  T  C  L  P  N  G  I  N  G  I  K  D  A  R
 421 CCTAAGAGCCTTAGTGAAACTTGTTTACCTAATGGCATAAATGGTATCAAAGATGCAAGG
  30 K  V  T  V  G  V  I  G  S  G  D  F  A  K  S  L  T  I  R  L
 481 AAGGTCACTGTAGGTGTGATTGGAAGTGGAGATTTTGCCAAATCCTTGACCATTCGACTT
  50 I  R  C  G  Y  H  V  V  I  G  S  R  N  P  K  F  A  S  E  F
 541 ATTAGATGCGGCTATCATGTGGTCATAGGAAGTAGAAATCCTAAGTTTGCTTCTGAATTT
  70 F  P  H  V  V  D  V  T  H  H  E  D  A  L  K  T  N  I  I
 601 TTTCCTCATGTGGTAGATGTCACTCATCATGAAGATGCTCTCACAAAAACAAATATAATA
  90 F  V  A  I  H  R  E  H  Y  T  S  L  W  D  L  R  H  L  L  V
 661 TTTGTTGCTATACACAGAGAACATTATACCTCCCTGTGGGACCTGAGACATCTGCTTGTG
 110 G  K  I  L  I  D  V  S  N  N  M  R  I  N  Q  Y  P  E  S  N
 721 GGTAAAATCCTGATTGATGTGAGCAATAACATGAGGATAAACCAGTACCCAGAATCCAAT
 130 A  E  Y  L  A  S  L  F  P  D  S  L  I  V  K  G  F  N  V  V
 781 GCTGAATATTTGGCTTCATTATTCCCAGATTCTTTGATTGTCAAAGGATTTAATGTTGTC
 150 S  A  W  A  L  Q  L  G  P  K  D  A  S  R  Q  V  Y  I  C  S
 841 TCAGCTTGGGCACTTCAGTTAGGACCTAAGGATGCCAGCCGGCAGGTTTATATATGCAGC
 170 N  N  I  Q  A  R  Q  Q  V  I  E  L  A  R  Q  L  N  F  I  P
 901 AACAATATTCAAGCGCGACAACAGGTTATTGAACTTGCCCGCCAGTTGAATTTCATTCCC
 190 I  D  L  G  S  L  S  S  A  R  E  I  E  N  L  P  L  R  L  F
 961 ATTGACTTGGGATCCTTATCATCAGCCAGAGAGATTGAAAATTTACCCCTACGACTCTTT
 210 T  L  W  R  G  P  V  V  V  A  I  S  L  A  T  F  F  F  L  Y
1021 ACTCTCTGGAGAGGGCCAGTGGTGGTAGCTATAAGCTTGGCCACATTTTTTTTCCTTTAT
 230 S  F  V  R  D  V  I  H  P  Y  A  R  N  Q  Q  S  D  F  Y  K
1081 TCCTTTGTCAGAGATGTGATTCATCCATATGCTAGAAACCAACAGAGTGACTTTTACAAA
 250 I  P  I  E  I  V  N  K  T  L  P  I  V  A  I  T  L  L  S  L
1141 ATTCCTATAGAGATTGTGAATAAAACCTTACCTATAGTTGCCATTACTTTGCTCTCCCTA
 270 V  Y  L  A  G  L  L  A  A  A  Y  Q  L  Y  Y  G  T  K  Y  R
1201 GTATACCTTGCAGGTCTTCTGGCAGCTGCTTATCAACTTTATTACGGCACCAAGTATAGG
 290 R  F  P  P  W  L  E  T  W  L  Q  C  R  K  Q  L  G  L  L  S
```

Figure 2H-2

```
1261 AGATTTCCACCTTGGTTGGAAACCTGGTTACAGTGTAGAAAACAGCTTGGATTACTAAGT
 310  F  F  F  A  M  V  H  V  A  Y  S  L  C  L  P  M  R  R  S  E
1321 TTTTTCTTCGCTATGGTCCATGTTGCCTACAGCCTCTGCTTACCGATGAGAAGGTCAGAG
 330  R  Y  L  F  L  N  M  A  Y  Q  Q  V  H  A  N  I  E  N  S  W
1381 AGATATTTGTTTCTCAACATGGCTTATCAGCAGGTTCATGCAAATATTGAAAACTCTTGG
 350  N  E  E  V  W  R  I  E  M  Y  I  S  F  G  I  M  S  L  G
1441 AATGAGGAAGAAGTTTGGAGAATTGAAATGTATATCTCCTTTGGCATAATGAGCCTTGGC
 370  L  L  S  L  L  A  V  T  S  I  P  S  V  S  N  A  L  N  W  R
1501 TTACTTTCCCTCCTGGCAGTCACTTCTATCCCTTCAGTGAGCAATGCTTTAAACTGGAGA
 390  E  F  S  F  I  Q  S  T  L  G  Y  V  A  L  L  I  S  T  F  H
1561 GAATTCAGTTTTATTCAGTCTACACTTGGATATGTCGCTCTGCTCATAAGTACTTTCCAT
 410  V  L  I  Y  G  W  K  R  A  F  E  E  E  Y  Y  R  F  Y  T  P
1621 GTTTTAATTTATGGATGGAAACGAGCTTTTGAGGAAGAGTACTACAGATTTTATACACCA
 430  P  N  F  V  L  A  L  V  L  P  S  I  V  I  L  G  K  I  I  L
1681 CCAAACTTTGTTCTTGCTCTTGTTTTGCCCTCAATTGTAATTCTGGGTAAGATTATTTTA
 450  F  L  P  C  I  S  R  K  L  K  R  I  K  K  G  W  E  K  S  Q
1741 TTCCTTCCATGTATAAGCCGAAAGCTAAAACGAATTAAAAAAGGCTGGGAAAAGAGCCAA
 470  F  L  E  E  G  M  G  G  T  I  P  H  V  S  P  E  R  V  T  V
1801 TTTCTGGAAGAAGGTATGGGAGGAACAATTCCTCATGTCTCCCCGGAGAGGGTCACAGTA
 490  M  *
1861 ATGTGAtgacaaatggtgttcacagctgccatataaagttctactcatgccattatttt
1921 atgacttctacgttcagttacaagtatgctgtcaaattatcgtgggttgaaacttgttaa
1981 atgagatttcaactgacttagtgatagagttttcttcaagttaattttcacaaatgtcat
2041 gtttgccaatatgaattttctagtcaacatattattgtaatttaggtatgttttgtttt
2101 gttttgcacaactgtaaccctgttgttactttatatttcataatcaggcaaaaatactta
2161 cagttaataatatagatataatgttaaaaacaatttgcaaaccagcagaattttaagctt
2221 ttaaaataattcaatggatatacattttttctgaagattaagattttaattattcaact
2281 taaaaagtagaaatgcattattatacattttttaagaaaggacacgttatgttagcatc
2341 taggtaaggctgcatgatagcattcctatatttctctcataaaataggatttgaaggatg
2401 aaattaattgtatgaagcaatgtgattatatgaagagacacaaattaaaaagacaaatta
2461 aacctgaaattatatttaaaatatatttgagacatgaaatacatactgataatacatacc
2521 tcatgaaagattttattctttattgtgttacagagcagtttcattttcatattaatatac
2581 tgatcaggaagaggattcagtaacatttggcttccaaaactgctatctctaatacggtac
2641 caatcctaggaactgtatactagttcctacttagaacaaaagtatcaagtttgcacacaa
2701 gtaatctgccagctgacctttgtcgcaccttaaccagtcaccacttgctatggtatagga
2761 ttatactgatgttctttgagggattctgatgtgctaggcatggttctaagtactttactt
2821 gtattatcccatttaatacttagaacaaccccgtgagataagtagttattatcctcattt
2881 tacacatgagggaccgaaggatagaaaagttatttttcaaaggtcttgcagttaataaat
2941 ggcagagtgagcattcaagtccaggtagtcatattccagaggccacggttttaaccacta
```

Figure 2H-3

```
3001 ggctctagagctcccgccgcgcccctatgcattatgttcacaatgccaatctagatgctt
3061 cctcttttgtataaagtcactgacattctttagagtgggttgggtgcatccaaaaatgta
3121 taaaaatattattataataaacttattactgcttgtagggtaattcacagttacttaccc
3181 tattcttgcttggaacatgagcctggagacccatggcagtccatatgcctccctatgcag
3241 tgaagggccctagcagtgttaacaaattgctgagatcccacggagtctttcaaaaatctc
3301 tgtagagttagtcttctccttttctcttcctgagaagttctcctgcctgcataaccattc
3361 attagggagtacttttacaagcatgaaggatattagggtaagtggctaattataaatctac
3421 tctagagacatataatcatacagattattcataaaattttcagtgctgtccttccacat
3481 ttaattgcattttgctcaaactgtagaatgccctacattcccccacccaatttgctat
3541 ttccttattaaaatagaaaattataggcaagatacaattatatgcgttcctcttcctgaa
3601 attataacatttctaaacttacccacgtaggtactactgaatccaactgccaacaataaa
3661 aagactttatttagtagaggctacctttcccaccagtgactcttttctacaactgcct
3721 tgtcagtttggtaattcacttatgattttctaatgttctcttggtgaattttattatctt
3781 gtaccctcttttttttttttttttttaaagacagagtcttgctctgtcacccaggct
3841 ggagtgcagtggcacgatctcggctcactgcaagctctgcctcccgggttcacgccattc
3901 tcctgcctcagcctcccgagtagctgggactacaggtgcccgccaccatgcccggctgat
3961 ttcttttttgtattttttagtagagacggagtttcaccgtgttagccaggatggtctcgatc
4021 tcctgacctcgtgatccgcccgccttggcctccaaagtgctgggattacaggtgtgagct
4081 accgcgcccggcctattatcttgtactttctaactgagccctctattttctttatttaa
4141 taatatttctccccacttgagaatcacttgttagttcttggtaggaattcagttgggcaa
4201 tgataacttttatgggcaaaaacattctattatagtgaactaatgaaaataacagcgtat
4261 tttcaatattttcttattccttaaattccactcttttaacactatgcttaaccacttaat
4321 gtgatgaaatattcctaaaagttaaatgactattaaagcatatattgttgcatgtatata
4381 ttaagtagccgatactctaaataaaaataccactgttacagataaatggggcctttaaaa
4441 atatgaaaaacaaacttgtgaaaatgtataaaagatgcatctgttgtttcaaatggcact
4501 atcttcttttcagtactacaaaaacagaataattttgaagttttagaataaatgtaatat
4561 atttactataattctaaatgtttaaatgcttttctaaaaatgcaaaactatgatgtttag
4621 ttgctttattttacctctatgtgattattttcttaattgttatttttataatcattat
4681 ttttctgaaccattcttctggcctcagaagtaggactgaattctactattgctaggtgtg
4741 agaaagtggtggtgagaaccttagagcagtggagatttgctacctggtctgtgttttgag
4801 aagtgccccttagaaaagttaaaagaatgtagaaaagatactcagtcttaatcctatgcaa
4861 aaaaaaaatcaagtaattgttttcctatgaggaaaataaccatgagctgtatcatgcta
4921 cttagcttttatgtaaatatttcttatgtctcctctattaagagtatttaaaatcatatt
4981 taaatatgaatctattcatgctaacattattttcaaaacatacatggaaatttagccca
5041 gattgtctacatataaggttttatttgaattgtaaaatatttaaaagtatgaataaaat
5101 atatttataggtatttatcagagatgattattttgtgctacatacaggttggctaatgag
5161 ctctagtgttaaactacctgattaatttcttataaagcagcataaccttggcttgattaa
5221 ggaattctactttcaaaaattaatctgataatagtaacaaggtatattactttcatta
5281 caatcaaattatagaaattacttgtgtaaaagggcttcaagaatatatccaattttaaa
```

Figure 2H-4

```
5341 tattttaatatatctcctatctgataacttaattcttctaaattaccacttgccattaag
5401 ctatttcataataaattctgtacagtttcccccaaaaaagagatttatttatgaaatat
5461 ttaaagtttctaatgtggtattttaaataaagtatcataaatgtaataagtaaatattta
5521 tttaggaatactgtgaacactgaactaattattcctgtgtcagtctatgaaatccctgtt
5581 ttgaaatacgtaaacagcctaaaatgtgttgaaattattttgtaaatccatgacttaaaa
5641 caagatacatacatagtataacacacctcacagtgttaagatttatattgtgaaatgaga
5701 caccctaccttcaattgttcatcagtgggtaaaacaaattctgatgtacattcaggacaa
5761 atgattagccctaaatgaaactgtaataatttcagtggaaactcaatctgttttacctt
5821 taaacagtgaattttacatgaatgaatgggttcttcacttttttttagtatgagaaaat
5881 tatacagtgcttaattttcagagattctttccatatgttactaaaaaatgttttgttcag
5941 cctaacatactgagttttttttaactttctaaattattgaatttccatcatgcattcatc
6001 caaaattaaggcagactgtttggattcttccagtggccagatgagctaaattaaatcaca
6061 aaagcagatgcttttgtatgatctccaaattgccaactttaaggaaatattctcttgaaa
6121 ttgtctttaaagatcttttgcagctttgcagatacccagactgagctggaactggaattt
6181 gtcttcctattgactctacttctttaaaagcggctgcccattacattcctcagctgtcct
6241 tgcagttaggtgtacatgtgactgagtgttggccagtgagatgaagtctcctcaaaggaa
6301 ggcagcatgtgtccttttcatcccttcatcttgctgctgggattgtggatataacagga
6361 gccctggcagctgtctccagaggatcaaagccacacccaaagagtaaggcagattagaga
6421 ccagaaagaccttgactacttccctacttccactgcttttcctgcatttaagccattgt
6481 aaatctgggtgtgttacatgaagtgaaaattaattctttctgcccttcagttctttatcc
6541 tgataccatttaacactgtctgaattaactagactgcaataattctttcttttgaaagct
6601 tttaaaggataatgtgcaattcacattaaaattgattttccattgtcaattagttatact
6661 cattttcctgccttgatctttcattagatattttgtatctgcttggaatatattatcttc
6721 tttttaactgtgtaattggtaattactaaaactctgtaatctccaaaatattgctatcaa
6781 attacacaccatgttttctatcattctcatagatctgccttataaacatttaaataaaaa
6841 gtactatttaatgattt
```

Figure 2I-1

The cDNA (SEQ ID. NO. : 18) and amino acid sequence (SEQ ID. NO. : 19) of 98P4B6 v.9. The start methionine is underlined. The open reading frame extends from nucleic acid 355-1719 including the stop codon.

```
   1 ggacgcgtgggcggacgcgtgggttcctcgggccctcggcgccacgagctgtccgggcac
  61 gcagccctagcggcgcgtcgctgccaagccggcctccgcgcgcctccctccttccttct
 121 cccctggctgttcgcgatccagcttgggtaggcggggaagcagctggagtgcgaccgcca
 181 cggcagccaccctgcaaccgccagtcggaggtgcagtccgtaggccctggccccgggtg
 241 ggcccttggggagtcggcgccgctcccgaggagctgcaaggctcgcccctgcccggcgtg
   1                                                          M  E
 301 gagggcgcggggggcgcggaggatattcttggtgatcttggaagtgtccgtatcATGGAA
   3 S  I  S  M  M  G  S  P  K  S  L  S  E  T  C  L  P  N  G  I
 361 TCAATCTCTATGATGGGAAGCCCTAAGAGCCTTAGTGAAACTTGTTTACCTAATGGCATA
  23 N  G  I  K  D  A  R  K  V  T  V  G  V  I  G  S  G  D  F  A
 421 AATGGTATCAAAGATGCAAGGAAGGTCACTGTAGGTGTGATTGGAAGTGGAGATTTTGCC
  43 K  S  L  T  I  R  L  I  R  C  G  Y  H  V  V  I  G  S  R  N
 481 AAATCCTTGACCATTCGACTTATTAGATGCGGCTATCATGTGGTCATAGGAAGTAGAAAT
  63 P  K  F  A  S  E  F  F  P  H  V  V  D  V  T  H  H  E  D  A
 541 CCTAAGTTTGCTTCTGAATTTTTTCCTCATGTGGTAGATGTCACTCATCATGAAGATGCT
  83 L  T  K  T  N  I  I  F  V  A  I  H  R  E  H  Y  T  S  L  W
 601 CTCACAAAAACAAATATAATATTTGTTGCTATACACAGAGAACATTATACCTCCCTGTGG
 103 D  L  R  H  L  L  V  G  K  I  L  I  D  V  S  N  N  M  R  I
 661 GACCTGAGACATCTGCTTGTGGGTAAAATCCTGATTGATGTGAGCAATAACATGAGGATA
 123 N  Q  Y  P  E  S  N  A  E  Y  L  A  S  L  F  P  D  S  L  I
 721 AACCAGTACCCAGAATCCAATGCTGAATATTTGGCTTCATTATTCCCAGATTCTTTGATT
 143 V  K  G  F  N  V  V  S  A  W  A  L  Q  L  G  P  K  D  A  S
 781 GTCAAAGGATTTAATGTTGTCTCAGCTTGGGCACTTCAGTTAGGACCTAAGGATGCCAGC
 163 R  Q  V  Y  I  C  S  N  N  I  Q  A  R  Q  Q  V  I  E  L  A
 841 CGGCAGGTTTATATATGCAGCAACAATATTCAAGCGCGACAACAGGTTATTGAACTTGCC
 183 R  Q  L  N  F  I  P  I  D  L  G  S  L  S  S  A  R  E  I  E
 901 CGCCAGTTGAATTTCATTCCCATTGACTTGGGATCCTTATCATCAGCCAGAGAGATTGAA
 203 N  L  P  L  R  L  F  T  L  W  R  G  P  V  V  V  A  I  S  L
 961 AATTTACCCCTACGACTCTTTACTCTCTGGAGAGGGCCAGTGGTGGTAGCTATAAGCTTG
 223 A  T  F  F  L  Y  S  F  V  R  D  V  I  H  P  Y  A  R  N
1021 GCCACATTTTTTTTCCTTTATTCCTTTGTCAGAGATGTGATTCATCCATATGCTAGAAAC
 243 Q  Q  S  D  F  Y  K  I  P  I  E  I  V  N  K  T  L  P  I  V
1081 CAACAGAGTGACTTTTACAAAATTCCTATAGAGATTGTGAATAAAACCTTACCTATAGTT
 263 A  I  T  L  L  S  L  V  Y  L  A  G  L  L  A  A  A  Y  Q  L
1141 GCCATTACTTTGCTCTCCCTAGTATACCTTGCAGGTCTTCTGGCAGCTGCTTATCAACTT
 283 Y  Y  G  T  K  Y  R  R  F  P  P  W  L  E  T  W  L  Q  C  R
1201 TATTACGGCACCAAGTATAGGAGATTTCCACCTTGGTTGGAAACCTGGTTACAGTGTAGA
 303 K  Q  L  G  L  L  S  F  F  F  A  M  V  H  V  A  Y  S  L  C
```

Figure 2I-2

```
1261 AAACAGCTTGGATTACTAAGTTTTTTCTTCGCTATGGTCCATGTTGCCTACAGCCTCTGC
 323  L  P  M  R  R  S  E  R  Y  L  F  L  N  M  A  Y  Q  Q  V  H
1321 TTACCGATGAGAAGGTCAGAGAGATATTTGTTTCTCAACATGGCTTATCAGCAGGTTCAT
 343  A  N  I  E  N  S  W  N  E  E  E  V  W  R  I  E  M  Y  I  S
1381 GCAAATATTGAAAACTCTTGGAATGAGGAAGAAGTTTGGAGAATTGAAATGTATATCTCC
 363  F  G  I  M  S  L  G  L  L  S  L  L  A  V  T  S  I  P  S  V
1441 TTTGGCATAATGAGCCTTGGCTTACTTTCCTCCTGGCAGTCACTTCTATCCCTTCAGTG
 383  S  N  A  L  N  R  E  F  S  F  I  Q  S  T  L  G  Y  V  A
1501 AGCAATGCTTTAAACTGGAGAGAATTCAGTTTTATTCAGTCTACACTTGGATATGTCGCT
 403  L  L  I  S  T  F  H  V  L  I  Y  G  W  K  R  A  F  E  E  E
1561 CTGCTCATAAGTACTTTCCATGTTTTAATTTATGGATGGAAACGAGCTTTTGAGGAAGAG
 423  Y  Y  R  F  Y  T  P  P  N  F  V  L  A  L  V  L  P  S  I  V
1621 TACTACAGATTTATACACCACCAAACTTTGTTCTTGCTCTTGTTTTGCCCTCAATTGTA
 443  I  L  D  L  L  Q  L  C  R  Y  P  D  *
1681 ATTCTGGATCTTTTGCAGCTTTGCAGATACCCAGACTGAgctggaactggaatttgtctt
1741 cctattgactctacttctttaaaagcggctgcccattacattcctcagctgtccttgcag
1801 ttaggtgtacatgtgactgagtgttggccagtgagatgaagtctcctcaaaggaaggcag
1861 catgtgtcctttttcatcccttcatcttgctgctgggattgtggatataacaggagccct
1921 ggcagctgtctccagaggatcaaagccacacccaaagagtaaggcagattagagaccaga
1981 aagaccttgactacttccctacttccactgcttttcctgcatttaagccattgtaaatct
2041 gggtgtgttacatgaagtgaaaattaattctttctgcccttcagttctttatcctgatac
2101 catttaacactgtctgaattaactagactgcaataattctttcttttgaaagcttttaaa
2161 ggataatgtgcaattcacattaaaattgattttccattgtcaattagttatactcatttt
2221 cctgccttgatctttcattagatattttgtatctgcttggaatatattatcttctttta
2281 actgtgtaattggtaattactaaaactctgtaatctccaaaatattgctatcaaattaca
2341 caccatgttttctatcattctcatagatctgccttataaacatttaaataaaaagtacta
2401 tttaatgatttaaaaaaaaaaaaaaaaaaaaaaaaaaaaaaaaaaaaaaaaaa
```

Figure 2J-1

The cDNA (SEQ ID. NO. : 20) and amino acid sequence (SEQ ID. NO. : 21) of 98P4B6 v.10. The start methionine is underlined. The open reading frame extends from nucleic acid 355-1719 including the stop codon.

```
   1 ggacgcgtgggcggacgcgtgggttcctcgggccctcggcgccacaagctgtccgggcac
  61 gcagcccctagcggcgcgtcgctgccaagccggcctccgcgcgcctccctccttccttct
 121 ccctggctgttcgcgatccagcttgggtaggcggggaagcagctggagtgcgaccgcta
 181 cggcagccaccctgcaaccgccagtcggaggtgcagtccgtaggccctggccccgggtg
 241 ggcccttggggagtcggcgccgctcccgaggagctgcaaggctcgccctgccggcgtg
   1                                                          M  E
 301 gagggcgcggggggcgcggaggatattcttggtgatcttggaagtgtccgtatcATGGAA
   3 S  I  S  M  M  G  S  P  K  S  L  S  E  T  C  L  P  N  G  I
 361 TCAATCTCTATGATGGGAAGCCCTAAGAGCCTTAGTGAAACTTGTTTACCTAATGGCATA
  23 N  G  I  K  D  A  R  K  V  T  V  G  V  I  G  S  G  D  F  A
 421 AATGGTATCAAAGATGCAAGGAAGGTCACTGTAGGTGTGATTGGAAGTGGAGATTTTGCC
  43 K  S  L  T  I  R  L  I  R  C  G  Y  H  V  V  I  G  S  R  N
 481 AAATCCTTGACCATTCGACTTATTAGATGCGGCTATCATGTGGTCATAGGAAGTAGAAAT
  63 P  K  F  A  S  E  F  F  P  H  V  V  D  V  T  H  H  E  D  A
 541 CCTAAGTTTGCTTCTGAATTTTTTCCTCATGTGGTAGATGTCACTCATCATGAAGATGCT
  83 L  T  K  T  N  I  I  F  V  A  I  H  R  E  H  Y  T  S  L  W
 601 CTCACAAAAACAAATATAATATTTGTTGCTATACACAGAGAACATTATACCTCCCTGTGG
 103 D  L  R  H  L  L  V  G  K  I  L  I  D  V  S  N  N  M  R  I
 661 GACCTGAGACATCTGCTTGTGGGTAAAATCCTGATTGATGTGAGCAATAACATGAGGATA
 123 N  Q  Y  P  E  S  N  A  E  Y  L  A  S  L  F  P  D  S  L  I
 721 AACCAGTACCCAGAATCCAATGCTGAATATTTGGCTTCATTATTCCCAGATTCTTTGATT
 143 V  K  G  F  N  V  V  S  A  W  A  L  Q  L  G  P  K  D  A  S
 781 GTCAAAGGATTTAATGTTGTCTCAGCTTGGGCACTTCAGTTAGGACCTAAGGATGCCAGC
 163 R  Q  V  Y  I  C  S  N  N  I  Q  A  R  Q  Q  V  I  E  L  A
 841 CGGCAGGTTTATATATGCAGCAACAATATTCAAGCGCGACAACAGGTTATTGAACTTGCC
 183 R  Q  L  N  F  I  P  I  D  L  G  S  L  S  S  A  R  E  I  E
 901 CGCCAGTTGAATTTCATTCCCATTGACTTGGGATCCTTATCATCAGCCAGAGAGATTGAA
 203 N  L  P  L  R  L  F  T  L  W  R  G  P  V  V  V  A  I  S  L
 961 AATTTACCCCTACGACTCTTTACTCTCTGGAGAGGGCCAGTGGTGGTAGCTATAAGCTTG
 223 A  T  F  F  L  Y  S  F  V  R  D  V  I  H  P  Y  A  R  N
1021 GCCACATTTTTTTTCCTTTATTCCTTTGTCAGAGATGTGATTCATCCATATGCTAGAAAC
 243 Q  Q  S  D  F  Y  K  I  P  I  E  I  V  N  K  T  L  P  I  V
1081 CAACAGAGTGACTTTTACAAAATTCCTATAGAGATTGTGAATAAAACCTTACCTATAGTT
 263 A  I  T  L  L  S  L  V  Y  L  A  G  L  L  A  A  A  Y  Q  L
1141 GCCATTACTTTGCTCTCCCTAGTATACCTTGCAGGTCTTCTGGCAGCTGCTTATCAACTT
 283 Y  Y  G  T  K  Y  R  R  F  P  P  W  L  E  T  W  L  Q  C  R
```

Figure 2J-2

```
1201 TATTACGGCACCAAGTATAGGAGATTTCCACCTTGGTTGGAAACCTGGTTACAGTGTAGA
 303  K  Q  L  G  L  L  S  F  F  F  A  M  V  H  V  A  Y  S  L  C
1261 AAACAGCTTGGATTACTAAGTTTTTTCTTCGCTATGGTCCATGTTGCCTACAGCCTCTGC
 323  L  P  M  R  R  S  E  R  Y  L  F  L  N  M  A  Y  Q  Q  V  H
1321 TTACCGATGAGAAGGTCAGAGAGATATTTGTTTCTCAACATGGCTTATCAGCAGGTTCAT
 343  A  N  I  E  N  S  W  N  E  E  E  V  W  R  I  E  M  Y  I  S
1381 GCAAATATTGAAAACTCTTGGAATGAGGAAGAAGTTTGGAGAATTGAAATGTATATCTCC
 363  F  G  I  M  S  L  G  L  L  S  L  L  A  V  T  S  I  P  S  V
1441 TTTGGCATAATGAGCCTTGGCTTACTTTCCCTCCTGGCAGTCACTTCTATCCCTTCAGTG
 383  S  N  A  L  N  W  R  E  F  S  F  I  Q  S  T  L  G  Y  V  A
1501 AGCAATGCTTTAAACTGGAGAGAATTCAGTTTTATTCAGTCTACACTTGGATATGTCGCT
 403  L  L  I  S  T  F  H  V  L  I  Y  G  W  K  R  A  F  E  E  E
1561 CTGCTCATAAGTACTTTCCATGTTTTAATTTATGGATGGAAACGAGCTTTTGAGGAAGAG
 423  Y  Y  R  F  Y  T  P  P  N  F  V  L  A  L  V  L  P  S  I  V
1621 TACTACAGATTTTATACACCACCAAACTTTGTTCTTGCTCTTGTTTTGCCCTCAATTGTA
 443  I  L  D  L  L  Q  L  C  R  Y  P  D  *
1681 ATTCTGGATCTTTTGCAGCTTTGCAGATACCCAGACTGAgctggaactggaatttgtctt
1741 cctattgactctacttctttaaaagcggctgcccattacattcctcagctgtccttgcag
1801 ttaggtgtacatgtgactgagtgttggccagtgagatgaagtctcctcaaaggaaggcag
1861 catgtgtccttttcatcccttcatcttgctgctgggattgtggatataacaggagccct
1921 ggcagctgtctccagaggatcaaagccacacccaaagagtaaggcagattagagaccaga
1981 aagaccttgactacttccctacttccactgcttttcctgcatttaagccattgtaaatct
2041 gggtgtgttacatgaagtgaaaattaattctttctgcccttcagttctttatcctgatac
2101 catttaacactgtctgaattaactagactgcaataattctttcttttgaaagcttttaaa
2161 ggataatgtgcaattcacattaaaattgattttccattgtcaattagttatactcatttt
2221 cctgccttgatctttcattagatattttgtatctgcttggaatatattatcttcttttta
2281 actgtgtaattggtaattactaaaactctgtaatctccaaaatattgctatcaaattaca
2341 caccatgttttctatcattctcatagatctgccttataaacatttaaataaaaagtacta
2401 tttaatgatttaaaaaaaaaaaaaaaaaaaaaaaaaaaaaaaaaaaaaaaa
```

Figure 2K-1

The cDNA (SEQ ID. NO. : 22) and amino acid sequence (SEQ ID. NO. : 23) of 98P4B6 v.11. The start methionine is underlined. The open reading frame extends from nucleic acid 355-1719 including the stop codon.

```
   1 ggacgcgtgggcggacgcgtgggttcctcgggccctcggcgccacaagctgtccgggcac
  61 gcagccctagcggcgcgtcgctgccaagccggcctccgcgcgcctccctccttccttct
 121 ccctggctgttcgcgatccagcttgggtaggcggggaagcagctggagtgcgaccgccg
 181 cggcagccaccctgcaaccgccagtcggaggtgcagtccgtaggccctggccccgggtg
 241 ggcccttggggagtcggcgccgctcccgaggagctgcaaggctcgccctgcccggcgtg
                                                            M  E
 301 gagggcgcggggggcgcggaggatattcttggtgatcttggaagtgtccgtatcATGGAA
   3 S  I  S  M  M  G  S  P  K  S  L  S  E  T  C  L  P  N  G  I
 361 TCAATCTCTATGATGGGAAGCCCTAAGAGCCTTAGTGAAACTTGTTTACCTAATGGCATA
  23 N  G  I  K  D  A  R  K  V  T  V  G  V  I  G  S  G  D  F  A
 421 AATGGTATCAAAGATGCAAGGAAGGTCACTGTAGGTGTGATTGGAAGTGGAGATTTTGCC
  43 K  S  L  T  I  R  L  I  R  C  G  Y  H  V  V  I  G  S  R  N
 481 AAATCCTTGACCATTCGACTTATTAGATGCGGCTATCATGTGGTCATAGGAAGTAGAAAT
  63 P  K  F  A  S  E  F  F  P  H  V  V  D  V  T  H  H  E  D  A
 541 CCTAAGTTTGCTTCTGAATTTTTTCCTCATGTGGTAGATGTCACTCATCATGAAGATGCT
  83 L  T  K  T  N  I  I  F  V  A  I  H  R  E  H  Y  T  S  L  W
 601 CTCACAAAAACAAATATAATATTTGTTGCTATACACAGAGAACATTATACCTCCCTGTGG
 103 D  L  R  H  L  L  V  G  K  I  L  I  D  V  S  N  N  M  R  I
 661 GACCTGAGACATCTGCTTGTGGGTAAAATCCTGATTGATGTGAGCAATAACATGAGGATA
 123 N  Q  Y  P  E  S  N  A  E  Y  L  A  S  L  F  P  D  S  L  I
 721 AACCAGTACCCAGAATCCAATGCTGAATATTTGGCTTCATTATTCCCAGATTCTTTGATT
 143 V  K  G  F  N  V  V  S  A  W  A  L  Q  L  G  P  K  D  A  S
 781 GTCAAAGGATTTAATGTTGTCTCAGCTTGGGCACTTCAGTTAGGACCTAAGGATGCCAGC
 163 R  Q  V  Y  I  C  S  N  N  I  Q  A  R  Q  Q  V  I  E  L  A
 841 CGGCAGGTTTATATATGCAGCAACAATATTCAAGCGCGACAACAGGTTATTGAACTTGCC
 183 R  Q  L  N  F  I  P  I  D  L  G  S  L  S  S  A  R  E  I  E
 901 CGCCAGTTGAATTTCATTCCCATTGACTTGGGATCCTTATCATCAGCCAGAGAGATTGAA
 203 N  L  P  L  R  L  F  T  L  W  R  G  P  V  V  V  A  I  S  L
 961 AATTTACCCCTACGACTCTTTACTCTCTGGAGAGGGCCAGTGGTGGTAGCTATAAGCTTG
 223 A  T  F  F  L  Y  S  F  V  R  D  V  I  H  P  Y  A  R  N
1021 GCCACATTTTTTTTCCTTTATTCCTTTGTCAGAGATGTGATTCATCCATATGCTAGAAAC
 243 Q  Q  S  D  F  Y  K  I  P  I  E  I  V  N  K  T  L  P  I  V
1081 CAACAGAGTGACTTTTACAAAATTCCTATAGAGATTGTGAATAAAACCTTACCTATAGTT
 263 A  I  T  L  L  S  L  V  Y  L  A  G  L  L  A  A  A  Y  Q  L
1141 GCCATTACTTTGCTCTCCCTAGTATACCTTGCAGGTCTTCTGGCAGCTGCTTATCAACTT
 283 Y  Y  G  T  K  Y  R  R  F  P  P  W  L  E  T  W  L  Q  C  R
```

Figure 2K-2

```
1201 TATTACGGCACCAAGTATAGGAGATTTCCACCTTGGTTGGAAACCTGGTTACAGTGTAGA
 303 K  Q  L  G  L  L  S  F  F  F  A  M  V  H  V  A  Y  S  L  C
1261 AAACAGCTTGGATTACTAAGTTTTTTCTTCGCTATGGTCCATGTTGCCTACAGCCTCTGC
 323 L  P  M  R  R  S  E  R  Y  L  F  L  N  M  A  Y  Q  Q  V  H
1321 TTACCGATGAGAAGGTCAGAGAGATATTTGTTTCTCAACATGGCTTATCAGCAGGTTCAT
 343 A  N  I  E  N  S  W  N  E  E  E  V  W  R  I  E  M  Y  I  S
1381 GCAAATATTGAAAACTCTTGGAATGAGGAAGAAGTTTGGAGAATTGAAATGTATATCTCC
 363 F  G  I  M  S  L  G  L  L  S  L  L  A  V  T  S  I  P  S  V
1441 TTTGGCATAATGAGCCTTGGCTTACTTTCCCTCCTGGCAGTCACTTCTATCCCTTCAGTG
 383 S  N  A  L  N  W  R  E  F  S  F  I  Q  S  T  L  G  Y  V  A
1501 AGCAATGCTTTAAACTGGAGAGAATTCAGTTTTATTCAGTCTACACTTGGATATGTCGCT
 403 L  L  I  S  T  F  H  V  L  I  Y  G  W  K  R  A  F  E  E  E
1561 CTGCTCATAAGTACTTTCCATGTTTTAATTTATGGATGGAAACGAGCTTTTGAGGAAGAG
 423 Y  Y  R  F  Y  T  P  P  N  F  V  L  A  L  V  L  P  S  I  V
1621 TACTACAGATTTTATACACCACCAAACTTTGTTCTTGCTCTTGTTTTGCCCTCAATTGTA
 443 I  L  D  L  L  Q  L  C  R  Y  P  D  *
1681 ATTCTGGATCTTTTGCAGCTTTGCAGATACCCAGACTGAgctggaactggaatttgtctt
1741 cctattgactctacttctttaaaagcggctgcccattacattcctcagctgtccttgcag
1801 ttaggtgtacatgtgactgagtgttggccagtgagatgaagtctcctcaaaggaaggcag
1861 catgtgtcctttttcatcccttcatcttgctgctgggattgtggatataacaggagccct
1921 ggcagctgtctccagaggatcaaagccacacccaaagagtaaggcagattagagaccaga
1981 aagaccttgactacttccctacttccactgcttttcctgcatttaagccattgtaaatct
2041 gggtgtgttacatgaagtgaaaattaattctttctgcccttcagttctttatcctgatac
2101 catttaacactgtctgaattaactagactgcaataattctttcttttgaaagcttttaaa
2161 ggataatgtgcaattcacattaaaattgattttccattgtcaattagttatactcatttt
2221 cctgccttgatctttcattagatattttgtatctgcttggaatatattatcttctttta
2281 actgtgtaattggtaattactaaaactctgtaatctccaaaatattgctatcaaattaca
2341 caccatgttttctatcattctcatagatctgccttataaacatttaataaaagtacta
2401 tttaatgatttaaaaaaaaaaaaaaaaaaaaaaaaaaaaaaaaaaaaaaaaaa
```

Figure 2L-1

The cDNA (SEQ ID. NO. : 24) and amino acid sequence (SEQ ID. NO. : 25) of 98P4B6 v.12. The start methionine is underlined. The open reading frame extends from nucleic acid 355-1719 including the stop codon.

```
   1 ggacgcgtgggcggacgcgtgggttcctcgggccctcggcgccacaagctgtccggcac
  61 gcagcccctagcggcgcgtcgctgccaagccggcctccgcgcgcctccctccttccttct
 121 cccctggctgttcgcgatccagcttgggtaggcggggaagcagctggagtgcgaccgcca
 181 cggcagccaccctgcaaccgccagtcggaggtgcagtccgtaggccctggccccgggtg
 241 ggcccttggggagtcggcgccgctcccggggagctgcaaggctcgcccctgcccggcgtg
                                                              M  E
 301 gagggcgcggggggcgcggaggatattcttggtgatcttggaagtgtccgtatcATGGAA
   3 S  I  S  M  M  G  S  P  K  S  L  S  E  T  C  L  P  N  G  I
 361 TCAATCTCTATGATGGGAAGCCCTAAGAGCCTTAGTGAAACTTGTTTACCTAATGGCATA
  23 N  G  I  K  D  A  R  K  V  T  V  G  V  I  G  S  G  D  F  A
 421 AATGGTATCAAAGATGCAAGGAAGGTCACTGTAGGTGTGATTGGAAGTGGAGATTTTGCC
  43 K  S  L  T  I  R  L  I  R  C  G  Y  H  V  V  I  G  S  R  N
 481 AAATCCTTGACCATTCGACTTATTAGATGCGGCTATCATGTGGTCATAGGAAGTAGAAAT
  63 P  K  F  A  S  E  F  F  P  H  V  V  D  V  T  H  E  D  A
 541 CCTAAGTTTGCTTCTGAATTTTTTCCTCATGTGGTAGATGTCACTCATCATGAAGATGCT
  83 L  T  K  T  N  I  I  F  V  A  I  H  R  E  H  Y  T  S  L  W
 601 CTCACAAAAACAAATATAATATTTGTTGCTATACACAGAGAACATTATACCTCCCTGTGG
 103 D  L  R  H  L  L  V  G  K  I  L  I  D  V  S  N  N  M  R  I
 661 GACCTGAGACATCTGCTTGTGGGTAAAATCCTGATTGATGTGAGCAATAACATGAGGATA
 123 N  Q  Y  P  E  S  N  A  E  Y  L  A  S  L  F  P  D  S  L  I
 721 AACCAGTACCCAGAATCCAATGCTGAATATTTGGCTTCATTATTCCCAGATTCTTTGATT
 143 V  K  G  F  N  V  V  S  A  W  A  L  Q  L  G  P  K  D  A  S
 781 GTCAAAGGATTTAATGTTGTCTCAGCTTGGGCACTTCAGTTAGGACCTAAGGATGCCAGC
 163 R  Q  V  Y  I  C  S  N  N  I  Q  A  R  Q  Q  V  I  E  L  A
 841 CGGCAGGTTTATATATGCAGCAACAATATTCAAGCGCGACAACAGGTTATTGAACTTGCC
 183 R  Q  L  N  F  I  P  I  D  L  G  S  L  S  S  A  R  E  I  E
 901 CGCCAGTTGAATTTCATTCCCATTGACTTGGGATCCTTATCATCAGCCAGAGAGATTGAA
 203 N  L  P  L  R  L  F  T  L  W  R  G  P  V  V  V  A  I  S  L
 961 AATTTACCCCTACGACTCTTTACTCTCTGGAGAGGGCCAGTGGTGGTAGCTATAAGCTTG
 223 A  T  F  F  F  L  Y  S  F  V  R  D  V  I  H  P  Y  A  R  N
1021 GCCACATTTTTTTTCCTTTATTCCTTTGTCAGAGATGTGATTCATCCATATGCTAGAAAC
 243 Q  Q  S  D  F  Y  K  I  P  I  E  I  V  N  K  T  L  P  I  V
1081 CAACAGAGTGACTTTTACAAAATTCCTATAGAGATTGTGAATAAAACCTTACCTATAGTT
 263 A  I  T  L  L  S  L  V  Y  L  A  G  L  L  A  A  A  Y  Q  L
1141 GCCATTACTTTGCTCTCCCTAGTATACCTTGCAGGTCTTCTGGCAGCTGCTTATCAACTT
 283 Y  Y  G  T  K  Y  R  R  F  P  P  W  L  E  T  W  L  Q  C  R
```

Figure 2L-2

```
1201 TATTACGGCACCAAGTATAGGAGATTTCCACCTTGGTTGGAAACCTGGTTACAGTGTAGA
 303 K  Q  L  G  L  L  S  F  F  F  A  M  V  H  V  A  Y  S  L  C
1261 AAACAGCTTGGATTACTAAGTTTTTTCTTCGCTATGGTCCATGTTGCCTACAGCCTCTGC
 323 L  P  M  R  R  S  E  R  Y  L  F  L  N  M  A  Y  Q  Q  V  H
1321 TTACCGATGAGAAGGTCAGAGAGATATTTGTTTCTAACATGGCTTATCAGCAGGTTCAT
 343 A  N  I  E  N  S  W  N  E  E  V  W  R  I  E  M  Y  I  S
1381 GCAAATATTGAAAACTCTTGGAATGAGGAAGAAGTTTGGAGAATTGAAATGTATATCTCC
 363 F  G  I  M  S  L  G  L  L  S  L  L  A  V  T  S  I  P  S  V
1441 TTTGGCATAATGAGCCTTGGCTTACTTTCCCTCCTGGCAGTCACTTCTATCCCTTCAGTG
 383 S  N  A  L  N  W  R  E  F  S  F  I  Q  S  T  L  G  Y  V  A
1501 AGCAATGCTTTAAACTGGAGAGAATTCAGTTTTATTCAGTCTACACTTGGATATGTCGCT
 403 L  L  I  S  T  F  H  V  L  I  Y  G  W  K  R  A  F  E  E  E
1561 CTGCTCATAAGTACTTTCCATGTTTTAATTTATGGATGGAAACGAGCTTTTGAGGAAGAG
 423 Y  Y  R  F  Y  T  P  P  N  F  V  L  A  L  V  L  P  S  I  V
1621 TACTACAGATTTTATACACCACCAAACTTTGTTCTTGCTCTTGTTTTGCCCTCAATTGTA
 443 I  L  D  L  L  Q  L  C  R  Y  P  D  *
1681 ATTCTGGATCTTTTGCAGCTTTGCAGATACCCAGACTGAgctggaactggaatttgtctt
1741 cctattgactctacttctttaaaagcggctgcccattacattcctcagctgtccttgcag
1801 ttaggtgtacatgtgactgagtgttggccagtgagatgaagtctcctcaaaggaaggcag
1861 catgtgtccttttcatcccttcatcttgctgctgggattgtggatataacaggagccct
1921 ggcagctgtctccagaggatcaaagccacacccaaagagtaaggcagattagagaccaga
1981 aagaccttgactacttccctacttccactgcttttcctgcatttaagccattgtaaatct
2041 gggtgtgttacatgaagtgaaaattaattctttctgcccttcagttctttatcctgatac
2101 catttaacactgtctgaattaactagactgcaataattctttcttttgaaagcttttaaa
2161 ggataatgtgcaattcacattaaaattgattttccattgtcaattagttatactcatttt
2221 cctgccttgatctttcattagatattttgtatctgcttggaatatattatcttcttttta
2281 actgtgtaattggtaattactaaaactctgtaatctccaaaatattgctatcaaattaca
2341 caccatgttttctatcattctcatagatctgccttataaacatttaaataaaaagtacta
2401 tttaatgatttaaaaaaaaaaaaaaaaaaaaaaaaaaaaaaaaaaaaaaaa
```

Figure 2M-1

The cDNA (SEQ ID. NO. : 26) and amino acid sequence (SEQ ID. NO. : 27) of 98P4B6 v.13. The start methionine is underlined. The open reading frame extends from nucleic acid 355-1719 including the stop codon.

```
   1 ggacgcgtgggcggacgcgtgggttcctcgggccctcggcgccacaagctgtccgggcac
  61 gcagccctagcggcgcgtcgctgccaagccggcctccgcgcgcctccctccttccttct
 121 ccctggctgttcgcgatccagcttgggtaggcggggaagcagctggagtgcgaccgcca
 181 cggcagccaccctgcaaccgccagtcggaggtgcagtccgtaggccctggccccgggtg
 241 ggccttggggagtcggcgccgctcccgaggagctgcaaggctcgccctgccggcgtg
                                                              M   E
 301 gagggcgcggggggcgcggaggatattcttggtgatcttggaagtgtccgtatcATGGAA
   3 S   I   S   M   M   G   S   P   K   S   L   S   E   T   F   L   P   N   G   I
 361 TCAATCTCTATGATGGGAAGCCCTAAGAGCCTTAGTGAAACTTTTTTACCTAATGGCATA
  23 N   G   I   K   D   A   R   K   V   T   V   G   V   I   G   S   G   D   F   A
 421 AATGGTATCAAAGATGCAAGGAAGGTCACTGTAGGTGTGATTGGAAGTGGAGATTTTGCC
  43 K   S   L   T   I   R   L   I   R   C   G   Y   H   V   V   I   G   S   R   N
 481 AAATCCTTGACCATTCGACTTATTAGATGCGGCTATCATGTGGTCATAGGAAGTAGAAAT
  63 P   K   F   A   S   E   F   F   P   H   V   V   D   V   T   H   H   E   D   A
 541 CCTAAGTTTGCTTCTGAATTTTTTCCTCATGTGGTAGATGTCACTCATCATGAAGATGCT
  83 L   T   K   T   N   I   I   F   V   A   I   H   R   E   H   Y   T   S   L   W
 601 CTCACAAAAACAAATATAATATTTGTTGCTATACACAGAGAACATTATACCTCCCTGTGG
 103 D   L   R   H   L   L   V   G   K   I   L   I   D   V   S   N   N   M   R   I
 661 GACCTGAGACATCTGCTTGTGGGTAAAATCCTGATTGATGTGAGCAATAACATGAGGATA
 123 N   Q   Y   P   E   S   N   A   E   Y   L   A   S   L   F   P   D   S   L   I
 721 AACCAGTACCCAGAATCCAATGCTGAATATTTGGCTTCATTATTCCCAGATTCTTTGATT
 143 V   K   G   F   N   V   V   S   A   W   A   L   Q   L   G   P   K   D   A   S
 781 GTCAAAGGATTTAATGTTGTCTCAGCTTGGGCACTTCAGTTAGGACCTAAGGATGCCAGC
 163 R   Q   V   Y   I   C   S   N   N   I   Q   A   R   Q   Q   V   I   E   L   A
 841 CGGCAGGTTTATATATGCAGCAACAATATTCAAGCGCGACAACAGGTTATTGAACTTGCC
 183 R   Q   L   N   F   I   P   I   D   L   G   S   L   S   S   A   R   E   I   E
 901 CGCCAGTTGAATTTCATTCCCATTGACTTGGGATCCTTATCATCAGCCAGAGAGATTGAA
 203 N   L   P   L   R   L   F   T   L   W   R   G   P   V   V   V   A   I   S   L
 961 AATTTACCCCTACGACTCTTTACTCTCTGGAGAGGGCCAGTGGTGGTAGCTATAAGCTTG
 223 A   T   F   F   F   L   Y   S   F   V   R   D   V   I   H   P   Y   A   R   N
1021 GCCACATTTTTTTTCCTTTATTCCTTTGTCAGAGATGTGATTCATCCATATGCTAGAAAC
 243 Q   Q   S   D   F   Y   K   I   P   I   E   I   V   N   K   T   L   P   I   V
1081 CAACAGAGTGACTTTTACAAAATTCCTATAGAGATTGTGAATAAAACCTTACCTATAGTT
 263 A   I   T   L   L   S   L   V   Y   L   A   G   L   L   A   A   A   Y   Q   L
1141 GCCATTACTTTGCTCTCCCTAGTATACCTTGCAGGTCTTCTGGCAGCTGCTTATCAACTT
 283 Y   Y   G   T   K   Y   R   R   F   P   P   W   L   E   T   W   L   Q   C   R
```

Figure 2M-2

```
1201 TATTACGGCACCAAGTATAGGAGATTTCCACCTTGGTTGGAAACCTGGTTACAGTGTAGA
 303 K   Q   L   G   L   L   S   F   F   F   A   M   V   H   V   A   Y   S   L   C
1261 AAACAGCTTGGATTACTAAGTTTTTTCTTCGCTATGGTCCATGTTGCCTACAGCCTCTGC
 323 L   P   M   R   R   S   E   R   Y   L   F   L   N   M   A   Y   Q   Q   V   H
1321 TTACCGATGAGAAGGTCAGAGAGATATTTGTTTCTCAACATGGCTTATCAGCAGGTTCAT
 343 A   N   I   E   N   S   W   N   E   E   V   W   R   I   E   M   Y   I   S
1381 GCAAATATTGAAAACTCTTGGAATGAGGAAGAAGTTTGGAGAATTGAAATGTATATCTCC
 363 F   G   I   M   S   L   G   L   L   S   L   L   A   V   T   S   I   P   S   V
1441 TTTGGCATAATGAGCCTTGGCTTACTTTCCCTCCTGGCAGTCACTTCTATCCCTTCAGTG
 383 S   N   A   L   N   W   R   E   F   S   F   I   Q   S   T   L   G   Y   V   A
1501 AGCAATGCTTTAAACTGGAGAGAATTCAGTTTTATTCAGTCTACACTTGGATATGTCGCT
 403 L   L   I   S   T   F   H   V   L   I   Y   G   W   K   R   A   F   E   E   E
1561 CTGCTCATAAGTACTTTCCATGTTTTAATTTATGGATGGAAACGAGCTTTTGAGGAAGAG
 423 Y   Y   R   F   Y   T   P   P   N   F   V   L   A   L   V   L   P   S   I   V
1621 TACTACAGATTTTATACACCACCAAACTTTGTTCTTGCTCTTGTTTTGCCCTCAATTGTA
 443 I   L   D   L   L   Q   L   C   R   Y   P   D   *
1681 ATTCTGGATCTTTTGCAGCTTTGCAGATACCCAGACTGAgctggaactggaatttgtctt
1741 cctattgactctacttctttaaaagcggctgcccattacattcctcagctgtccttgcag
1801 ttaggtgtacatgtgactgagtgttggccagtgagatgaagtctcctcaaaggaaggcag
1861 catgtgtccttttcatcccttcatcttgctgctgggattgtggataacaggagccct
1921 ggcagctgtctccagaggatcaaagccacacccaaagagtaaggcagattagagaccaga
1981 aagaccttgactacttccctacttccactgcttttcctgcatttaagccattgtaaatct
2041 gggtgtgttacatgaagtgaaaattaattctttctgcccttcagttctttatcctgatac
2101 catttaacactgtctgaattaactagactgcaataattctttcttttgaaagcttttaaa
2161 ggataatgtgcaattcacattaaaattgattttccattgtcaattagttatactcattt
2221 cctgccttgatctttcattagatattttgtatctgcttggaatatattatcttctttta
2281 actgtgtaattggtaattactaaaactctgtaatctccaaaatattgctatcaaattaca
2341 caccatgttttctatcattctcatagatctgccttataaacatttaaataaaaagtacta
2401 tttaatgatttaaaaaaaaaaaaaaaaaaaaaaaaaaaaaaaaaaaaaaaa
```

Figure 2N-1

The cDNA (SEQ ID. NO. : 28) and amino acid sequence (SEQ ID. NO. : 29) of 98P4B6 v.14. The start methionine is underlined. The open reading frame extends from nucleic acid 355-1719 including the stop codon.

```
   1 ggacgcgtgggcggacgcgtgggttcctcgggccctcggcgccacaagctgtccgggcac
  61 gcagccctagcggcgcgtcgctgccaagccggcctccgcgcgcctccctccttccttct
 121 cccctggctgttcgcgatccagcttgggtaggcggggaagcagctggagtgcgaccgcca
 181 cggcagccaccctgcaaccgccagtcggaggtgcagtccgtaggccctggccccggggtg
 241 ggcccttggggagtcggcgccgctcccgaggagctgcaaggctcgccctgcccggcgtg
   1                                                           M  E
 301 gagggcgcggggggcgcggaggatattcttggtgatcttggaagtgtccgtatcATGGAA
   3 S  I  S  M  M  G  S  P  K  S  L  S  E  T  C  L  P  N  G  I
 361 TCAATCTCTATGATGGGAAGCCCTAAGAGCCTTAGTGAAACTTGTTTACCTAATGGCATA
  23 N  G  I  K  D  A  R  K  V  T  V  G  V  I  G  S  G  D  F  A
 421 AATGGTATCAAAGATGCAAGGAAGGTCACTGTAGGTGTGATTGGAAGTGGAGATTTTGCC
  43 K  S  L  T  I  R  L  I  R  C  G  Y  H  V  V  I  G  S  R  N
 481 AAATCCTTGACCATTCGACTTATTAGATGCGGCTATCATGTGGTCATAGGAAGTAGAAAT
  63 P  K  F  A  S  E  F  F  P  H  V  V  D  V  T  H  H  E  D  A
 541 CCTAAGTTTGCTTCTGAATTTTTTCCTCATGTGGTAGATGTCACTCATCATGAAGATGCT
  83 L  T  K  N  I  I  F  V  A  I  H  R  E  H  Y  T  S  L  W
 601 CTCACAAAAACAAATATAATATTTGTTGCTATACACAGAGAACATTATACCTCCCTGTGG
 103 D  L  R  H  L  L  V  G  K  I  L  I  D  V  S  N  N  M  R  I
 661 GACCTGAGACATCTGCTTGTGGGTAAAATCCTGATTGATGTGAGCAATAACATGAGGATA
 123 N  Q  Y  P  E  S  N  A  E  Y  L  A  S  L  F  P  D  S  L  I
 721 AACCAGTACCCAGAATCCAATGCTGAATATTTGGCTTCATTATTCCCAGATTCTTTGATT
 143 V  K  G  F  N  V  V  S  A  W  A  L  Q  L  G  P  K  D  A  S
 781 GTCAAAGGATTTAATGTTGTCTCAGCTTGGGCACTTCAGTTAGGACCTAAGGATGCCAGC
 163 R  Q  V  Y  I  C  S  N  N  I  Q  A  R  Q  Q  V  I  E  L  A
 841 CGGCAGGTTTATATATGCAGCAACAATATTCAAGCGCGACAACAGGTTATTGAACTTGCC
 183 R  Q  L  N  F  I  P  I  D  L  G  S  L  S  S  A  R  E  I  E
 901 CGCCAGTTGAATTTCATTCCCATTGACTTGGGATCCTTATCATCAGCCAGAGAGATTGAA
 203 N  L  P  L  R  L  F  T  F  W  R  G  P  V  V  V  A  I  S  L
 961 AATTTACCCCTACGACTCTTTACTTTCTGGAGAGGGCCAGTGGTGGTAGCTATAAGCTTG
 223 A  T  F  F  F  L  Y  S  F  V  R  D  V  I  H  P  Y  A  R  N
1021 GCCACATTTTTTTTCCTTTATTCCTTTGTCAGAGATGTGATTCATCCATATGCTAGAAAC
 243 Q  Q  S  D  F  Y  K  I  P  I  E  I  V  N  K  T  L  P  I  V
1081 CAACAGAGTGACTTTTACAAAATTCCTATAGAGATTGTGAATAAAACCTTACCTATAGTT
 263 A  I  T  L  L  S  L  V  Y  L  A  G  L  L  A  A  A  Y  Q  L
1141 GCCATTACTTTGCTCTCCCTAGTATACCTTGCAGGTCTTCTGGCAGCTGCTTATCAACTT
 283 Y  Y  G  T  K  Y  R  R  F  P  P  W  L  E  T  W  L  Q  C  R
```

Figure 2N-2

```
1201 TATTACGGCACCAAGTATAGGAGATTTCCACCTTGGTTGGAAACCTGGTTACAGTGTAGA
 303 K   Q   L   G   L   L   S   F   F   F   A   M   V   H   V   A   Y   S   L   C
1261 AAACAGCTTGGATTACTAAGTTTTTTCTTCGCTATGGTCCATGTTGCCTACAGCCTCTGC
 323 L   P   M   R   R   S   E   R   Y   L   F   L   N   M   A   Y   Q   Q   V   H
1321 TTACCGATGAGAAGGTCAGAGAGATATTTGTTTCTCAACATGGCTTATCAGCAGGTTCAT
 343 A   N   I   E   N   S   W   N   E   E   E   V   W   R   I   E   M   Y   I   S
1381 GCAAATATTGAAAACTCTTGGAATGAGGAAGAAGTTTGGAGAATTGAAATGTATATCTCC
 363 F   G   I   M   S   L   G   L   L   S   L   L   A   V   T   S   I   P   S   V
1441 TTTGGCATAATGAGCCTTGGCTTACTTTCCCTCCTGGCAGTCACTTCTATCCCTTCAGTG
 383 S   N   A   L   N   W   R   E   F   S   F   I   Q   S   T   L   G   Y   V   A
1501 AGCAATGCTTTAAACTGGAGAGAATTCAGTTTTATTCAGTCTACACTTGGATATGTCGCT
 403 L   L   I   S   T   F   H   V   L   I   Y   G   W   K   R   A   F   E   E   E
1561 CTGCTCATAAGTACTTTCCATGTTTTAATTTATGGATGGAAACGAGCTTTTGAGGAAGAG
 423 Y   Y   R   F   Y   T   P   P   N   F   V   L   A   L   V   L   P   S   I   V
1621 TACTACAGATTTTATACACCACCAAACTTTGTTCTTGCTCTTGTTTTGCCCTCAATTGTA
 443 I   L   D   L   L   Q   L   C   R   Y   P   D   *
1681 ATTCTGGATCTTTTGCAGCTTTGCAGATACCCAGACTGAgctggaactggaatttgtctt
1741 cctattgactctacttctttaaaagcggctgcccattacattcctcagctgtccttgcag
1801 ttaggtgtacatgtgactgagtgttggccagtgagatgaagtctcctcaaaggaaggcag
1861 catgtgtccttttcatcccttcatcttgctgctgggattgtggatataacaggagccct
1921 ggcagctgtctccagaggatcaaagccacacccaaagagtaaggcagattagagaccaga
1981 aagaccttgactacttccctacttccactgcttttcctgcatttaagccattgtaaatct
2041 gggtgtgttacatgaagtgaaaattaattctttctgcccttcagttctttatcctgatac
2101 catttaacactgtctgaattaactagactgcaataattctttcttttgaaagcttttaaa
2161 ggataatgtgcaattcacattaaaattgatttccattgtcaattagttatactcatttt
2221 cctgccttgatctttcattagatattttgtatctgcttggaatatattatcttctttta
2281 actgtgtaattggtaattactaaaactctgtaatctccaaaatattgctatcaaattaca
2341 caccatgttttctatcattctcatagatctgccttataaacatttaaataaaagtacta
2401 tttaatgattta aaaaaaaaaaaaaaaaaaaaaaaaaaaaaaaaaaaaaaa
```

Figure 20-1

The cDNA (SEQ ID. NO. : 30) and amino acid sequence (SEQ ID. NO. : 31) of 98P4B6 v.15. The start methionine is underlined. The open reading frame extends from nucleic acid 355-1719 including the stop codon.

```
   1 ggacgcgtgggcggacgcgtgggttcctcgggccctcggcgccacaagctgtccgggcac
  61 gcagccctagcggcgcgtcgctgccaagccggcctccgcgcgcctccctccttccttct
 121 ccctggctgttcgcgatccagcttgggtaggcggggaagcagctggagtgcgaccgcca
 181 cggcagccaccctgcaaccgccagtcggaggtgcagtccgtaggccctggccccgggtg
 241 ggcccttggggagtcggcgccgctcccgaggagctgcaaggctcgccctgcccggcgtg
   1                                                          M  E
 301 gagggcgcggggggcgcggaggatattcttggtgatcttggaagtgtccgtatcATGGAA
   3 S  I  S  M  M  G  S  P  K  S  L  S  E  T  C  L  P  N  G  I
 361 TCAATCTCTATGATGGGAAGCCCTAAGAGCCTTAGTGAAACTTGTTTACCTAATGGCATA
  23 N  G  I  K  D  A  R  K  V  T  V  G  V  I  G  S  G  D  F  A
 421 AATGGTATCAAAGATGCAAGGAAGGTCACTGTAGGTGTGATTGGAAGTGGAGATTTTGCC
  43 K  S  L  T  I  R  L  I  R  C  G  Y  H  V  V  I  G  S  R  N
 481 AAATCCTTGACCATTCGACTTATTAGATGCGGCTATCATGTGGTCATAGGAAGTAGAAAT
  63 P  K  F  A  S  E  F  F  P  H  V  V  D  V  T  H  H  E  D  A
 541 CCTAAGTTTGCTTCTGAATTTTTTCCTCATGTGGTAGATGTCACTCATCATGAAGATGCT
  83 L  T  K  T  N  I  I  F  V  A  I  H  R  E  H  Y  T  S  L  W
 601 CTCACAAAAACAAATATAATATTTGTTGCTATACACAGAGAACATTATACCTCCCTGTGG
 103 D  L  R  H  L  L  V  G  K  I  L  I  D  V  S  N  N  M  R  I
 661 GACCTGAGACATCTGCTTGTGGGTAAAATCCTGATTGATGTGAGCAATAACATGAGGATA
 123 N  Q  Y  P  E  S  N  A  E  Y  L  A  S  L  F  P  D  S  L  I
 721 AACCAGTACCCAGAATCCAATGCTGAATATTTGGCTTCATTATTCCCAGATTCTTTGATT
 143 V  K  G  F  N  V  V  S  A  W  A  L  Q  L  G  P  K  D  A  S
 781 GTCAAAGGATTTAATGTTGTCTCAGCTTGGGCACTTCAGTTAGGACCTAAGGATGCCAGC
 163 R  Q  V  Y  I  C  S  N  N  I  Q  A  R  Q  Q  V  I  E  L  A
 841 CGGCAGGTTTATATATGCAGCAACAATATTCAAGCGCGACAACAGGTTATTGAACTTGCC
 183 R  Q  L  N  F  I  P  I  D  L  G  S  L  S  S  A  R  E  I  E
 901 CGCCAGTTGAATTTCATTCCCATTGACTTGGGATCCTTATCATCAGCCAGAGAGATTGAA
 203 N  L  P  L  R  L  F  T  L  W  R  G  P  V  V  V  A  I  S  L
 961 AATTTACCCCTACGACTCTTTACTCTCTGGAGAGGGCCAGTGGTGGTAGCTATAAGCTTG
 223 A  T  F  F  F  L  Y  S  F  V  R  D  V  I  H  P  Y  A  R  N
1021 GCCACATTTTTTTTCCTTTATTCCTTTGTCAGAGATGTGATTCATCCATATGCTAGAAAC
 243 Q  Q  S  D  F  Y  K  I  P  I  E  I  V  N  K  T  L  P  I  V
1081 CAACAGAGTGACTTTTACAAAATTCCTATAGAGATTGTGAATAAAACCTTACCTATAGTT
 263 A  I  T  L  L  S  L  V  Y  L  A  G  L  L  A  A  A  Y  Q  L
1141 GCCATTACTTTGCTCTCCCTAGTATACCTCGCAGGTCTTCTGGCAGCTGCTTATCAACTT
 283 Y  Y  G  T  K  Y  R  R  F  P  P  W  L  E  T  W  L  Q  C  R
```

Figure 20-2

```
1201 TATTACGGCACCAAGTATAGGAGATTTCCACCTTGGTTGGAAACCTGGTTACAGTGTAGA
 303 K  Q  L  G  L  L  S  F  F  F  A  M  V  H  V  A  Y  S  L  C
1261 AAACAGCTTGGATTACTAAGTTTTTTCTTCGCTATGGTCCATGTTGCCTACAGCCTCTGC
 323 L  P  M  R  R  S  E  R  Y  L  F  L  N  M  A  Y  Q  Q  V  H
1321 TTACCGATGAGAAGGTCAGAGAGATATTTGTTTCTCAACATGGCTTATCAGCAGGTTCAT
 343 A  N  I  E  N  S  W  N  E  E  V  W  R  I  E  M  Y  I  S
1381 GCAAATATTGAAAACTCTTGGAATGAGGAAGAAGTTTGGAGAATTGAAATGTATATCTCC
 363 F  G  I  M  S  L  G  L  L  S  L  L  A  V  T  S  I  P  S  V
1441 TTTGGCATAATGAGCCTTGGCTTACTTTCCTCCTGGCAGTCACTTCTATCCCTTCAGTG
 383 S  N  A  L  N  W  R  E  F  S  F  I  Q  S  T  L  G  Y  V  A
1501 AGCAATGCTTTAAACTGGAGAGAATTCAGTTTTATTCAGTCTACACTTGGATATGTCGCT
 403 L  L  I  S  T  F  H  V  L  I  Y  G  W  K  R  A  F  E  E  E
1561 CTGCTCATAAGTACTTTCCATGTTTTAATTTATGGATGGAAACGAGCTTTTGAGGAAGAG
 423 Y  Y  R  F  Y  T  P  P  N  F  V  L  A  L  V  L  P  S  I  V
1621 TACTACAGATTTTATACACCACCAAACTTTGTTCTTGCTCTTGTTTTGCCCTCAATTGTA
 443 I  L  D  L  L  Q  L  C  R  Y  P  D  *
1681 ATTCTGGATCTTTTGCAGCTTTGCAGATACCCAGACTGAgctggaactggaatttgtctt
1741 cctattgactctacttctttaaaagcggctgcccattacattcctcagctgtccttgcag
1801 ttaggtgtacatgtgactgagtgttggccagtgagatgaagtctcctcaaaggaaggcag
1861 catgtgtccttttttcatcccttcatcttgctgctgggattgtggatataacaggagccct
1921 ggcagctgtctccagaggatcaaagccacacccaaagagtaaggcagattagagaccaga
1981 aagaccttgactacttccctacttccactgcttttcctgcatttaagccattgtaaatct
2041 gggtgtgttacatgaagtgaaaattaattctttctgcccttcagttctttatcctgatac
2101 catttaacactgtctgaattaactagactgcaataattcttcttttgaaagcttttaaa
2161 ggataatgtgcaattcacattaaaattgattttccattgtcaattagttatactcatttt
2221 cctgccttgatctttcattagatattttgtatctgcttggaatatattatcttcttttta
2281 actgtgtaattggtaattactaaaactctgtaatctccaaaatattgctatcaaattaca
2341 caccatgttttctatcattctcatagatctgccttataaacatttaaataaaaagtacta
2401 tttaatgatttaaaaaaaaaaaaaaaaaaaaaaaaaaaaaaaaaaaaaaaa
```

Figure 2P-1

The cDNA (SEQ ID. NO. : 32) and amino acid sequence (SEQ ID. NO. : 33) of 98P4B6 v.16. The start methionine is underlined. The open reading frame extends from nucleic acid 355-1719 including the stop codon.

```
   1 ggacgcgtgggcggacgcgtgggttcctcgggccctcggcgccacaagctgtccgggcac
  61 gcagcccctagcggcgcgtcgctgccaagccggcctccgcgcgcctccctccttccttct
 121 cccctggctgttcgcgatccagcttgggtaggcggggaagcagctggagtgcgaccgcca
 181 cggcagccaccctgcaaccgccagtcggaggtgcagtccgtaggccctggccccgggtg
 241 ggccttggggagtcggcgccgctcccgaggagctgcaaggctcgcccctgcccggcgtg
   1                                                            M  E
 301 gagggcgcggggggcgcggaggatattcttggtgatcttggaagtgtccgtatcATGGAA
   3 S  I  S  M  M  G  S  P  K  S  L  S  E  T  C  L  P  N  G  I
 361 TCAATCTCTATGATGGGAAGCCCTAAGAGCCTTAGTGAAACTTGTTTACCTAATGGCATA
  23 N  G  I  K  D  A  R  K  V  T  V  G  V  I  G  S  G  D  F  A
 421 AATGGTATCAAAGATGCAAGGAAGGTCACTGTAGGTGTGATTGGAAGTGGAGATTTTGCC
  43 K  S  L  T  I  R  L  I  R  C  G  Y  H  V  V  I  G  S  R  N
 481 AAATCCTTGACCATTCGACTTATTAGATGCGGCTATCATGTGGTCATAGGAAGTAGAAAT
  63 P  K  F  A  S  E  F  F  P  H  V  V  D  V  T  H  H  E  D  A
 541 CCTAAGTTTGCTTCTGAATTTTTTCCTCATGTGGTAGATGTCACTCATCATGAAGATGCT
  83 L  T  K  T  N  I  I  F  V  A  I  H  R  E  H  Y  T  S  L  W
 601 CTCACAAAAACAAATATAATATTTGTTGCTATACACAGAGAACATTATACCTCCCTGTGG
 103 D  L  R  H  L  L  V  G  K  I  L  I  D  V  S  N  N  M  R  I
 661 GACCTGAGACATCTGCTTGTGGGTAAAATCCTGATTGATGTGAGCAATAACATGAGGATA
 123 N  Q  Y  P  E  S  N  A  E  Y  L  A  S  L  F  P  D  S  L  I
 721 AACCAGTACCCAGAATCCAATGCTGAATATTTGGCTTCATTATTCCCAGATTCTTTGATT
 143 V  K  G  F  N  V  V  S  A  W  A  L  Q  L  G  P  K  D  A  S
 781 GTCAAAGGATTTAATGTTGTCTCAGCTTGGGCACTTCAGTTAGGACCTAAGGATGCCAGC
 163 R  Q  V  Y  I  C  S  N  N  I  Q  A  R  Q  Q  V  I  E  L  A
 841 CGGCAGGTTTATATATGCAGCAACAATATTCAAGCGCGACAACAGGTTATTGAACTTGCC
 183 R  Q  L  N  F  I  P  I  D  L  G  S  L  S  S  A  R  E  I  E
 901 CGCCAGTTGAATTTCATTCCCATTGACTTGGGATCCTTATCATCAGCCAGAGAGATTGAA
 203 N  L  P  L  R  L  F  T  L  W  R  G  P  V  V  A  I  S  L
 961 AATTTACCCCTACGACTCTTTACTCTCTGGAGAGGGCCAGTGGTGGTAGCTATAAGCTTG
 223 A  T  F  F  F  L  Y  S  F  V  R  D  V  I  H  P  Y  A  R  N
1021 GCCACATTTTTTTTCCTTTATTCCTTTGTCAGAGATGTGATTCATCCATATGCTAGAAAC
 243 Q  Q  S  D  F  Y  K  I  P  I  E  I  V  N  K  T  L  P  I  V
1081 CAACAGAGTGACTTTTACAAAATTCCTATAGAGATTGTGAATAAAACCTTACCTATAGTT
 263 A  I  T  L  L  S  L  V  Y  L  A  G  L  L  A  A  A  Y  Q  L
1141 GCCATTACTTTGCTCTCCCTAGTATACCTTGCAGGTCTTCTGGCAGCTGCTTATCAACTT
 283 Y  Y  G  T  K  Y  R  R  F  P  P  W  L  E  T  W  L  Q  C  R
```

Figure 2P-2

```
1201 TATTACGGCACCAAGTATAGGAGATTTCCACCTTGGTTGGAAACCTGGTTACAGTGTAGA
 303 K  Q  L  G  L  L  S  F  F  F  A  M  V  H  V  A  Y  S  L  C
1261 AAACAGCTTGGATTACTAAGTTTTTTCTTCGCTATGGTCCATGTTGCCTACAGCCTCTGC
 323 L  P  M  R  R  S  E  R  Y  L  F  L  N  M  A  Y  Q  Q  V  H
1321 TTACCGATGAGAAGGTCAGAGAGATATTTGTTTCTCAACATGGCTTATCAGCAGGTTCAT
 343 A  N  I  E  N  S  W  N  E  E  E  V  W  R  I  E  M  Y  I  S
1381 GCAAATATTGAAAACTCTTGGAATGAGGAAGAAGTTTGGAGAATTGAAATGTATATCTCC
 363 F  G  I  M  S  L  G  L  L  S  L  L  A  V  T  S  I  P  S  V
1441 TTTGGCATAATGAGCCTTGGCTTACTTTCCCTCCTGGCAGTCACTTCTATCCCTTCGGTG
 383 S  N  A  L  N  W  R  E  F  S  F  I  Q  S  T  L  G  Y  V  A
1501 AGCAATGCTTTAAACTGGAGAGAATTCAGTTTTATTCAGTCTACACTTGGATATGTCGCT
 403 L  L  I  S  T  F  H  V  L  I  Y  G  W  K  R  A  F  E  E  E
1561 CTGCTCATAAGTACTTTCCATGTTTTAATTTATGGATGGAAACGAGCTTTTGAGGAAGAG
 423 Y  Y  R  F  Y  T  P  P  N  F  V  L  A  L  V  L  P  S  I  V
1621 TACTACAGATTTTATACACCACCAAACTTTGTTCTTGCTCTTGTTTTGCCCTCAATTGTA
 443 I  L  D  L  L  Q  L  C  R  Y  P  D  *
1681 ATTCTGGATCTTTTGCAGCTTTGCAGATACCCAGACTGAgctggaactggaatttgtctt
1741 cctattgactctacttctttaaaagcggctgcccattacattcctcagctgtccttgcag
1801 ttaggtgtacatgtgactgagtgttggccagtgagatgaagtctcctcaaaggaaggcag
1861 catgtgtccttttcatcccttcatcttgctgctgggattgtggatataacaggagccct
1921 ggcagctgtctccagaggatcaaagccacacccaaagagtaaggcagattagagaccaga
1981 aagaccttgactacttccctacttccactgcttttcctgcatttaagccattgtaaatct
2041 gggtgtgttacatgaagtgaaaattaattctttctgcccttcagttctttatcctgatac
2101 catttaacactgtctgaattaactagactgcaataattctttcttttgaaagcttttaaa
2161 ggataatgtgcaattcacattaaaattgatttccattgtcaattagttatactcatttt
2221 cctgccttgatctttcattagatattttgtatctgcttggaatatattatcttctttta
2281 actgtgtaattggtaattactaaaactctgtaatctccaaaatattgctatcaaattaca
2341 caccatgttttctatcattctcatagatctgccttataaacatttaaataaaaagtacta
2401 tttaatgatttaaaaaaaaaaaaaaaaaaaaaaaaaaaaaaaaaaaaaaaa
```

Figure 2Q-1

The cDNA (SEQ ID. NO. : 34) and amino acid sequence (SEQ ID. NO. : 35) of 98P4B6 v.17. The start methionine is underlined. The open reading frame extends from nucleic acid 355-1719 including the stop codon.

```
   1 ggacgcgtgggcggacgcgtgggttcctcgggccctcggcgccacaagctgtccgggcac
  61 gcagccctagcggcgcgtcgctgccaagccggcctccgcgcgcctccctccttccttct
 121 cccctggctgttcgcgatccagcttgggtaggcggggaagcagctggagtgcgaccgcca
 181 cggcagccaccctgcaaccgccagtcggaggtgcagtccgtaggccctggccccgggtg
 241 ggccttggggagtcggcgccgctcccgaggagctgcaaggctcgccctgcccggcgtg
   1                                                           M  E
 301 gagggcgcggggggcgcggaggatattcttggtgatcttggaagtgtccgtatcATGGAA
   3 S  I  S  M  M  G  S  P  K  S  L  S  E  T  C  L  P  N  G  I
 361 TCAATCTCTATGATGGGAAGCCCTAAGAGCCTTAGTGAAACTTGTTTACCTAATGGCATA
  23 N  G  I  K  D  A  R  K  V  T  V  G  V  I  G  S  G  D  F  A
 421 AATGGTATCAAAGATGCAAGGAAGGTCACTGTAGGTGTGATTGGAAGTGGAGATTTTGCC
  43 K  S  L  T  I  R  L  I  R  C  G  Y  H  V  V  I  G  S  R  N
 481 AAATCCTTGACCATTCGACTTATTAGATGCGGCTATCATGTGGTCATAGGAAGTAGAAAT
  63 P  K  F  A  S  E  F  F  P  H  V  V  D  V  T  H  H  E  D  A
 541 CCTAAGTTTGCTTCTGAATTTTTTCCTCATGTGGTAGATGTCACTCATCATGAAGATGCT
  83 L  T  K  T  N  I  I  F  V  A  I  H  R  E  H  Y  T  S  L  W
 601 CTCACAAAAACAAATATAATATTTGTTGCTATACACAGAGAACATTATACCTCCCTGTGG
 103 D  L  R  H  L  L  V  G  K  I  L  I  D  V  S  N  N  M  R  I
 661 GACCTGAGACATCTGCTTGTGGGTAAAATCCTGATTGATGTGAGCAATAACATGAGGATA
 123 N  Q  Y  P  E  S  N  A  E  Y  L  A  S  L  F  P  D  S  L  I
 721 AACCAGTACCCAGAATCCAATGCTGAATATTTGGCTTCATTATTCCCAGATTCTTTGATT
 143 V  K  G  F  N  V  V  S  A  W  A  L  Q  L  G  P  K  D  A  S
 781 GTCAAAGGATTTAATGTTGTCTCAGCTTGGGCACTTCAGTTAGGACCTAAGGATGCCAGC
 163 R  Q  V  Y  I  C  S  N  N  I  Q  A  R  Q  Q  V  I  E  L  A
 841 CGGCAGGTTTATATATGCAGCAACAATATTCAAGCGCGACAACAGGTTATTGAACTTGCC
 183 R  Q  L  N  F  I  P  I  D  L  G  S  L  S  S  A  R  E  I  E
 901 CGCCAGTTGAATTTCATTCCCATTGACTTGGGATCCTTATCATCAGCCAGAGAGATTGAA
 203 N  L  P  L  R  L  F  T  L  W  R  G  P  V  V  A  I  S  L
 961 AATTTACCCCTACGACTCTTTACTCTCTGGAGAGGGCCAGTGGTGGTAGCTATAAGCTTG
 223 A  T  F  F  F  L  Y  S  F  V  R  D  V  I  H  P  Y  A  R  N
1021 GCCACATTTTTTTTCCTTTATTCCTTTGTCAGAGATGTGATTCATCCATATGCTAGAAAC
 243 Q  Q  S  D  F  Y  K  I  P  I  E  I  V  N  K  T  L  P  I  V
1081 CAACAGAGTGACTTTTACAAAATTCCTATAGAGATTGTGAATAAAACCTTACCTATAGTT
 263 A  I  T  L  L  S  L  V  Y  L  A  G  L  L  A  A  A  Y  Q  L
1141 GCCATTACTTTGCTCTCCCTAGTATACCTTGCAGGTCTTCTGGCAGCTGCTTATCAACTT
 283 Y  Y  G  T  K  Y  R  R  F  P  P  W  L  E  T  W  L  Q  C  R
```

Figure 2Q-2

```
1201 TATTACGGCACCAAGTATAGGAGATTTCCACCTTGGTTGGAAACCTGGTTACAGTGTAGA
 303 K   Q   L   G   L   L   S   F   F   F   A   M   V   H   V   A   Y   S   L   C
1261 AAACAGCTTGGATTACTAAGTTTTTTCTTCGCTATGGTCCATGTTGCCTACAGCCTCTGC
 323 L   P   M   R   R   S   E   R   Y   L   F   L   N   M   A   Y   Q   Q   V   H
1321 TTACCGATGAGAAGGTCAGAGAGATATTTGTTTCTCAACATGGCTTATCAGCAGGTTCAT
 343 A   N   I   E   N   S   W   N   E   E   E   V   W   R   I   E   M   Y   I   S
1381 GCAAATATTGAAAACTCTTGGAATGAGGAAGAAGTTTGGAGAATTGAAATGTATATCTCC
 363 F   G   I   M   S   L   G   L   L   S   L   L   A   V   T   S   I   P   S   V
1441 TTTGGCATAATGAGCCTTGGCTTACTTTCCCTCCTGGCAGTCACTTCTATCCCTTCAGTG
 383 S   N   A   L   N   W   R   E   F   S   F   I   Q   S   T   L   G   Y   V   A
1501 AGCAATGCTTTAAACTGGAGAGAATTCAGTTTTATTCAGTCTACACTTGGATATGTCGCT
 403 L   L   I   S   T   F   H   V   L   I   Y   G   W   K   R   A   F   E   E   E
1561 CTGCTCATAAGTACTTTCCATGTTTTAATTTATGGATGGAAACGAGCTTTTGAGGAAGAG
 423 Y   Y   R   F   Y   T   P   P   N   F   V   L   A   L   V   P   S   I   V
1621 TACTACAGATTTTATACACCACCAAACTTTGTTCTTGCTCTTGTTTTGCCCTCAATTGTA
 443 I   L   D   L   L   Q   L   C   R   Y   P   D   *
1681 ATTCTGGATCTTTTGCAGCTTTGCAGATACCCAGACTGAgctggaactggaatttgtctt
1741 cctatggactctacttctttaaaagcggctgcccattacattcctcagctgtccttgcag
1801 ttaggtgtacatgtgactgagtgttggccagtgagatgaagtctcctcaaaggaaggcag
1861 catgtgtcctttttcatcccttcatcttgctgctgggattgtggatataacaggagccct
1921 ggcagctgtctccagaggatcaaagccacacccaaagagtaaggcagattagagaccaga
1981 aagaccttgactacttccctacttccactgcttttcctgcatttaagccattgtaaatct
2041 gggtgtgttacatgaagtgaaaattaattctttctgcccttcagttctttatcctgatac
2101 catttaacactgtctgaattaactagactgcaataattctttcttttgaaagcttttaaa
2161 ggataatgtgcaattcacattaaaattgattttccattgtcaattagttatactcatttt
2221 cctgccttgatctttcattagatattttgtatctgcttggaatatattatcttctttta
2281 actgtgtaattggtaattactaaaactctgtaatctccaaaatattgctatcaaattaca
2341 caccatgttttctatcattctcatagatctgccttataaacatttaaataaaaagtacta
2401 tttaatgatttaaaaaaaaaaaaaaaaaaaaaaaaaaaaaaaaaaaaaaaa
```

Figure 2R-1

The cDNA (SEQ ID. NO. : 36) and amino acid sequence (SEQ ID. NO. : 37) of 98P4B6 v.18. The start methionine is underlined. The open reading frame extends from nucleic acid 355-1719 including the stop codon.

```
   1 ggacgcgtgggcggacgcgtgggttcctcgggccctcggcgccacaagctgtccgggcac
  61 gcagccctagcggcgcgtcgctgccaagccggcctccgcgcgcctccctccttccttct
 121 cccctggctgttcgcgatccagcttgggtaggcggggaagcagctggagtgcgaccgcca
 181 cggcagccaccctgcaaccgccagtcggaggtgcagtccgtaggccctggccccgggtg
 241 ggcccttggggagtcggcgccgctcccgaggagctgcaaggctcgcccctgcccggcgtg
   1                                                            M   E
 301 gagggcgcggggggcgcggaggatattcttggtgatcttggaagtgtccgtatcATGGAA
   3 S   I   S   M   M   G   S   P   K   S   L   S   E   T   C   L   P   N   G   I
 361 TCAATCTCTATGATGGGAAGCCCTAAGAGCCTTAGTGAAACTTGTTTACCTAATGGCATA
  23 N   G   I   K   D   A   R   K   V   T   V   G   V   I   G   S   G   D   F   A
 421 AATGGTATCAAAGATGCAAGGAAGGTCACTGTAGGTGTGATTGGAAGTGGAGATTTTGCC
  43 K   S   L   T   I   R   L   I   R   C   G   Y   H   V   V   I   G   S   R   N
 481 AAATCCTTGACCATTCGACTTATTAGATGCGGCTATCATGTGGTCATAGGAAGTAGAAAT
  63 P   K   F   A   S   E   F   F   P   H   V   V   D   V   T   H   H   E   D   A
 541 CCTAAGTTTGCTTCTGAATTTTTTCCTCATGTGGTAGATGTCACTCATCATGAAGATGCT
  83 L   T   K   T   N   I   I   F   V   A   I   H   R   E   H   Y   T   S   L   W
 601 CTCACAAAAACAAATATAATATTTGTTGCTATACACAGAGAACATTATACCTCCCTGTGG
 103 D   L   R   H   L   L   V   G   K   I   L   I   D   V   S   N   N   M   R   I
 661 GACCTGAGACATCTGCTTGTGGGTAAAATCCTGATTGATGTGAGCAATAACATGAGGATA
 123 N   Q   Y   P   E   S   N   A   E   Y   L   A   S   L   F   P   D   S   L   I
 721 AACCAGTACCCAGAATCCAATGCTGAATATTTGGCTTCATTATTCCCAGATTCTTTGATT
 143 V   K   G   F   N   V   V   S   A   W   A   L   Q   L   G   P   K   D   A   S
 781 GTCAAAGGATTTAATGTTGTCTCAGCTTGGGCACTTCAGTTAGGACCTAAGGATGCCAGC
 163 R   Q   V   Y   I   C   S   N   N   I   Q   A   R   Q   Q   V   I   E   L   A
 841 CGGCAGGTTTATATATGCAGCAACAATATTCAAGCGCGACAACAGGTTATTGAACTTGCC
 183 R   Q   L   N   F   I   P   I   D   L   G   S   L   S   S   A   R   E   I   E
 901 CGCCAGTTGAATTTCATTCCCATTGACTTGGGATCCTTATCATCAGCCAGAGAGATTGAA
 203 N   L   P   L   R   L   F   T   L   W   R   G   P   V   V   V   A   I   S   L
 961 AATTTACCCCTACGACTCTTTACTCTCTGGAGAGGGCCAGTGGTGGTAGCTATAAGCTTG
 223 A   T   F   F   L   Y   S   F   V   R   D   V   I   H   P   Y   A   R   N
1021 GCCACATTTTTTTTCCTTTATTCCTTTGTCAGAGATGTGATTCATCCATATGCTAGAAAC
 243 Q   Q   S   D   F   Y   K   I   P   I   E   I   V   N   K   T   L   P   I   V
1081 CAACAGAGTGACTTTTACAAAATTCCTATAGAGATTGTGAATAAAACCTTACCTATAGTT
 263 A   I   T   L   L   S   L   V   Y   L   A   G   L   L   A   A   A   Y   Q   L
1141 GCCATTACTTTGCTCTCCCTAGTATACCTTGCAGGTCTTCTGGCAGCTGCTTATCAACTT
 283 Y   Y   G   T   K   Y   R   R   F   P   P   W   L   E   T   W   L   Q   C   R
```

Figure 2R-2

```
1201 TATTACGGCACCAAGTATAGGAGATTTCCACCTTGGTTGGAAACCTGGTTACAGTGTAGA
 303 K  Q  L  G  L  L  S  F  F  F  A  M  V  H  V  A  Y  S  L  C
1261 AAACAGCTTGGATTACTAAGTTTTTTCTTCGCTATGGTCCATGTTGCCTACAGCCTCTGC
 323 L  P  M  R  R  S  E  R  Y  L  F  L  N  M  A  Y  Q  Q  V  H
1321 TTACCGATGAGAAGGTCAGAGAGATATTTGTTTCTCAACATGGCTTATCAGCAGGTTCAT
 343 A  N  I  E  N  S  W  N  E  E  V  W  R  I  E  M  Y  I  S
1381 GCAAATATTGAAAACTCTTGGAATGAGGAAGAAGTTTGGAGAATTGAAATGTATATCTCC
 363 F  G  I  M  S  L  G  L  L  S  L  L  A  V  T  S  I  P  S  V
1441 TTTGGCATAATGAGCCTTGGCTTACTTTCCCTCCTGGCAGTCACTTCTATCCCTTCAGTG
 383 S  N  A  L  N  W  R  E  F  S  F  I  Q  S  T  L  G  Y  V  A
1501 AGCAATGCTTTAAACTGGAGAGAATTCAGTTTTATTCAGTCTACACTTGGATATGTCGCT
 403 L  L  I  S  T  F  H  V  L  I  Y  G  W  K  R  A  F  E  E  E
1561 CTGCTCATAAGTACTTTCCATGTTTTAATTTATGGATGGAAACGAGCTTTTGAGGAAGAG
 423 Y  R  F  Y  T  P  P  N  F  V  L  A  L  V  L  P  S  I  V
1621 TACTACAGATTTTATACACCACCAAACTTTGTTCTTGCTCTTGTTTTGCCCTCAATTGTA
 443 I  L  D  L  L  Q  L  C  R  Y  P  D  *
1681 ATTCTGGATCTTTTGCAGCTTTGCAGATACCCAGACTGAgctggaactggaatttgtctt
1741 cctattgactctacttctttaaaagcggctgcccattacattcctcagctgtccttgcag
1801 ttaggtgtacatgtgactgagtgttggccagtgagatgaagtctcctcaaaggaaggcag
1861 catgtgtccttttcatcccttcatcttgctgctgggattgtggatataacaggagccct
1921 ggcagctgtctccagaggatcaaagccacacccaaagagtaaggcagattagagaccaga
1981 aagaccttgactacttccctacttccactgcttttcctgcatttaagccattgtaaatct
2041 gggtgggttacatgaagtgaaaattaattctttctgcccttcagttctttatcctgatac
2101 catttaacactgtctgaattaactagactgcaataattctttctttgaaagcttttaaa
2161 ggataatgtgcaattcacattaaaattgattttccattgtcaattagttatactcatttt
2221 cctgccttgatctttcattagatattttgtatctgcttggaatatattatcttcttttta
2281 actgtgtaattggtaattactaaaactctgtaatctccaaaatattgctatcaaattaca
2341 caccatgttttctatcattctcatagatctgccttataaacatttaaataaaaagtacta
2401 tttaatgatttaaaaaaaaaaaaaaaaaaaaaaaaaaaaaaaaaaaaaaa
```

Figure 2S-1

The cDNA (SEQ ID. NO. : 38) and amino acid sequence (SEQ ID. NO. : 39) of 98P4B6 v.19. The start methionine is underlined. The open reading frame extends from nucleic acid 355-1719 including the stop codon.

```
   1 ggacgcgtgggcggacgcgtgggttcctcgggccctcggcgccacaagctgtccgggcac
  61 gcagccctagcggcgcgtcgctgccaagccggcctccgcgcgcctccctccttccttct
 121 ccctggctgttcgcgatccagcttgggtaggcggggaagcagctggagtgcgaccgcca
 181 cggcagccaccctgcaaccgccagtcggaggtgcagtccgtaggccctggcccccgggtg
 241 ggcccttggggagtcggcgccgctcccgaggagctgcaaggctcgcccctgccggcgtg
   1                                                           M  E
 301 gagggcgcggggggcgcggaggatattcttggtgatcttggaagtgtccgtatcATGGAA
   3 S  I  S  M  M  G  S  P  K  S  L  S  E  T  C  L  P  N  G  I
 361 TCAATCTCTATGATGGGAAGCCCTAAGAGCCTTAGTGAAACTTGTTTACCTAATGGCATA
  23 N  G  I  K  D  A  R  K  V  T  V  G  V  I  G  S  G  D  F  A
 421 AATGGTATCAAAGATGCAAGGAAGGTCACTGTAGGTGTGATTGGAAGTGGAGATTTTGCC
  43 K  S  L  T  I  R  L  I  R  C  G  Y  H  V  V  I  G  S  R  N
 481 AAATCCTTGACCATTCGACTTATTAGATGCGGCTATCATGTGGTCATAGGAAGTAGAAAT
  63 P  K  F  A  S  E  F  F  P  H  V  V  D  V  T  H  H  E  D  A
 541 CCTAAGTTTGCTTCTGAATTTTTTCCTCATGTGGTAGATGTCACTCATCATGAAGATGCT
  83 L  T  K  T  N  I  I  F  V  A  I  H  R  E  H  Y  T  S  L  W
 601 CTCACAAAAACAAATATAATATTTGTTGCTATACACAGAGAACATTATACCTCCCTGTGG
 103 D  L  R  H  L  L  V  G  K  I  L  I  D  V  S  N  N  M  R  I
 661 GACCTGAGACATCTGCTTGTGGGTAAAATCCTGATTGATGTGAGCAATAACATGAGGATA
 123 N  Q  Y  P  E  S  N  A  E  Y  L  A  S  L  F  P  D  S  L  I
 721 AACCAGTACCCAGAATCCAATGCTGAATATTTGGCTTCATTATTCCCAGATTCTTTGATT
 143 V  K  G  F  N  V  V  S  A  W  A  L  Q  L  G  P  K  D  A  S
 781 GTCAAAGGATTTAATGTTGTCTCAGCTTGGGCACTTCAGTTAGGACCTAAGGATGCCAGC
 163 R  Q  V  Y  I  C  S  N  N  I  Q  A  R  Q  Q  V  I  E  L  A
 841 CGGCAGGTTTATATATGCAGCAACAATATTCAAGCGCGACAACAGGTTATTGAACTTGCC
 183 R  Q  L  N  F  I  P  I  D  L  G  S  L  S  S  A  R  E  I  E
 901 CGCCAGTTGAATTTCATTCCCATTGACTTGGGATCCTTATCATCAGCCAGAGAGATTGAA
 203 N  L  P  L  R  L  F  T  L  W  R  G  P  V  V  V  A  I  S  L
 961 AATTTACCCCTACGACTCTTTACTCTCTGGAGAGGGCCAGTGGTGGTAGCTATAAGCTTG
 223 A  T  F  F  F  L  Y  S  F  V  R  D  V  I  H  P  Y  A  R  N
1021 GCCACATTTTTTTTCCTTTATTCCTTTGTCAGAGATGTGATTCATCCATATGCTAGAAAC
 243 Q  Q  S  D  F  Y  K  I  P  I  E  I  V  N  K  T  L  P  I  V
1081 CAACAGAGTGACTTTTACAAAATTCCTATAGAGATTGTGAATAAAACCTTACCTATAGTT
 263 A  I  T  L  L  S  L  V  Y  L  A  G  L  L  A  A  A  Y  Q  L
1141 GCCATTACTTTGCTCTCCCTAGTATACCTTGCAGGTCTTCTGGCAGCTGCTTATCAACTT
 283 Y  Y  G  T  K  Y  R  R  F  P  P  W  L  E  T  W  L  Q  C  R
```

Figure 2S-2

```
1201 TATTACGGCACCAAGTATAGGAGATTTCCACCTTGGTTGGAAACCTGGTTACAGTGTAGA
 303 K  Q  L  G  L  L  S  F  F  F  A  M  V  H  V  A  Y  S  L  C
1261 AAACAGCTTGGATTACTAAGTTTTTTCTTCGCTATGGTCCATGTTGCCTACAGCCTCTGC
 323 L  P  M  R  R  S  E  R  Y  L  F  N  M  A  Y  Q  Q  V  H
1321 TTACCGATGAGAAGGTCAGAGAGATATTTGTTTCTCAACATGGCTTATCAGCAGGTTCAT
 343 A  N  I  E  N  S  W  N  E  E  E  V  W  R  I  E  M  Y  I  S
1381 GCAAATATTGAAAACTCTTGGAATGAGGAAGAAGTTTGGAGAATTGAAATGTATATCTCC
 363 F  G  I  M  S  L  G  L  L  S  L  L  A  V  T  S  I  P  S  V
1441 TTTGGCATAATGAGCCTTGGCTTACTTTCCCTCCTGGCAGTCACTTCTATCCCTTCAGTG
 383 S  N  A  L  N  W  R  E  F  S  F  I  Q  S  T  L  G  Y  V  A
1501 AGCAATGCTTTAAACTGGAGAGAATTCAGTTTTATTCAGTCTACACTTGGATATGTCGCT
 403 L  L  I  S  T  F  H  V  L  I  Y  G  W  K  R  A  F  E  E  E
1561 CTGCTCATAAGTACTTTCCATGTTTTAATTTATGGATGGAAACGAGCTTTTGAGGAAGAG
 423 Y  Y  R  F  Y  T  P  P  N  F  V  L  A  L  V  L  P  S  I  V
1621 TACTACAGATTTTATACACCACCAAACTTTGTTCTTGCTCTTGTTTTGCCCTCAATTGTA
 443 I  L  D  L  L  Q  L  C  R  Y  P  D  *
1681 ATTCTGGATCTTTTGCAGCTTTGCAGATACCCAGACTGAgctggaactggaatttgtctt
1741 cctattgactctacttctttaaaagcggctgcccattacattcctcagctgtccttgcag
1801 ttaggtgtacatgtgactgagtgttggccagtgagatgaagtctcctcaaaggaaggcag
1861 catgtgtcctttttcatcccttcatcttgctgctgggattgtggatataacaggagccct
1921 ggcagctgtctccagaggatcaaagccacacccaaagagtaaggcagattagagaccaga
1981 aagaccttgactacttccctacttccactgcttttcctgcatttaagccattgtaaatct
2041 gggtgtgttacatgaagtgaaaattaattctttctgcccttcagttctttatcctgatac
2101 cacttaacactgtctgaattaactagactgcaataattctttcttttgaaagcttttaaa
2161 ggataatgtgcaattcacattaaaattgattttccattgtcaattagttatactcatttt
2221 cctgccttgatctttcattagatattttgtatctgcttggaatatattatcttcttttta
2281 actgtgtaattggtaattactaaaactctgtaatctccaaaatattgctatcaaattaca
2341 caccatgttttctatcattctcatagatctgccttataaacatttaaataaaaagtacta
2401 tttaatgatttaaaaaaaaaaaaaaaaaaaaaaaaaaaaaaaaaaaaaaaaaaa
```

Figure 2T-1

The cDNA (SEQ ID. NO. : 40) and amino acid sequence (SEQ ID. NO. : 41) of 98P4B6 v.20. The start methionine is underlined. The open reading frame extends from nucleic acid 295-2025 including the stop codon.

```
   1 ggagaaaatttacagaaacccagagccaaaggtgctctcaggggatcccctgaaacattc
  61 aaagccattgcggccccagaagcttgggtaggcggggaagcagctggagtgcgaccgccg
 121 cggcagccaccctgcaaccgccagtcggaggtgcagtccgtaggccctggccccgggtg
 181 ggcccttggggagtcggcgccgctcccggggagctgcaaggctcgcccctgcccggcgtg
   1                                                           M  E
 241 gagggcgcggggggcgcggaggatattcttggtgatcttggaagtgtccgtatcATGGAA
   3 S  I  S  M  M  G  S  P  K  S  L  S  E  T  F  L  P  N  G  I
 301 TCAATCTCTATGATGGGAAGCCCTAAGAGCCTTAGTGAAACTTTTTTACCTAATGGCATA
  23 N  G  I  K  D  A  R  K  V  T  G  V  I  G  S  G  D  F  A
 361 AATGGTATCAAAGATGCAAGGAAGGTCACTGTAGGTGTGATTGGAAGTGGAGATTTTGCC
  43 K  S  L  T  I  R  L  I  R  C  G  Y  H  V  V  I  G  S  R  N
 421 AAATCCTTGACCATTCGACTTATTAGATGCGGCTATCATGTGGTCATAGGAAGTAGAAAT
  63 P  K  F  A  S  E  F  F  P  H  V  V  D  V  T  H  H  E  D  A
 481 CCTAAGTTTGCTTCTGAATTTTTTCCTCATGTGGTAGATGTCACTCATCATGAAGATGCT
  83 L  T  K  T  N  I  I  F  V  A  I  H  R  E  H  Y  T  S  L  W
 541 CTCACAAAAACAAATATAATATTTGTTGCTATACACAGAGAACATTATACCTCCCTGTGG
 103 D  L  R  H  L  L  V  G  K  I  L  I  D  V  S  N  N  M  R  I
 601 GACCTGAGACATCTGCTTGTGGGTAAAATCCTGATTGATGTGAGCAATAACATGAGGATA
 123 N  Q  Y  P  E  S  N  A  E  Y  L  A  S  L  F  P  D  S  L  I
 661 AACCAGTACCCAGAATCCAATGCTGAATATTTGGCTTCATTATTCCCAGATTCTTTGATT
 143 V  K  G  F  N  V  V  S  A  W  A  L  Q  L  G  P  K  D  A  S
 721 GTCAAAGGATTTAATGTTGTCTCAGCTTGGGCACTTCAGTTAGGACCTAAGGATGCCAGC
 163 R  Q  V  Y  I  C  S  N  N  I  Q  A  R  Q  Q  V  I  E  L  A
 781 CGGCAGGTTTATATATGCAGCAACAATATTCAAGCGCGACAACAGGTTATTGAACTTGCC
 183 R  Q  L  N  F  I  P  I  D  L  G  S  L  S  S  A  R  E  I  E
 841 CGCCAGTTGAATTTCATTCCCATTGACTTGGGATCCTTATCATCAGCCAGAGAGATTGAA
 203 N  L  P  L  R  L  F  T  L  W  R  G  P  V  V  V  A  I  S  L
 901 AATTTACCCCTACGACTCTTTACTCTCTGGAGAGGGCCAGTGGTGGTAGCTATAAGCTTG
 223 A  T  F  F  L  Y  S  F  V  R  D  V  I  H  P  Y  A  R  N
 961 GCCACATTTTTTTTCCTTTATTCCTTTGTCAGAGATGTGATTCATCCATATGCTAGAAAC
 243 Q  Q  S  D  F  Y  K  I  P  I  E  I  V  N  K  T  L  P  I  V
1021 CAACAGAGTGACTTTTACAAAATTCCTATAGAGATTGTGAATAAAACCTTACCTATAGTT
 263 A  I  T  L  L  S  L  V  Y  L  A  G  L  L  A  A  A  Y  Q  L
1081 GCCATTACTTTGCTCTCCCTAGTATACCTCGCAGGTCTTCTGGCAGCTGCTTATCAACTT
 283 Y  G  T  K  Y  R  R  F  P  P  W  L  E  T  W  L  Q  C  R
```

Figure 2T-2

```
1141 TATTACGGCACCAAGTATAGGAGATTTCCACCTTGGTTGGAAACCTGGTTACAGTGTAGA
 303 K  Q  L  G  L  L  S  F  F  P  A  M  V  H  V  A  Y  S  L  C
1201 AAACAGCTTGGATTACTAAGTTTTTTCTTCGCTATGGTCCATGTTGCCTACAGCCTCTGC
 323 L  P  M  R  R  S  E  R  Y  L  F  N  M  A  Y  Q  Q  S  T
1261 TTACCGATGAGAAGGTCAGAGAGATATTTGTTTCTCAACATGGCTTATCAGCAGTCTACA
 343 L  G  Y  V  A  L  L  I  S  T  F  H  V  L  I  Y  G  W  K  R
1321 CTTGGATATGTCGCTCTGCTCATAAGTACTTTCCATGTTTTAATTTATGGATGGAAACGA
 363 A  F  E  E  Y  Y  R  F  Y  T  P  P  N  F  V  L  A  L  V
1381 GCTTTTGAGGAAGAGTACTACAGATTTTATACACCACCAAACTTTGTTCTTGCTCTTGTT
 383 L  P  S  I  V  I  L  D  L  S  V  E  V  L  A  S  P  A  A  A
1441 TTGCCCTCAATTGTAATTCTGGATCTGTCTGTGGAGGTTCTGGCTTCCCCAGCTGCTGCC
 403 W  K  C  L  G  A  N  I  L  R  G  G  L  S  E  I  V  L  P  I
1501 TGGAAATGCTTAGGTGCTAATATCCTGAGAGGAGGATTGTCAGAGATAGTACTCCCCATA
 423 E  W  Q  Q  D  R  K  I  P  P  L  S  T  P  P  P  P  A  M  W
1561 GAGTGGCAGCAGGACAGGAAGATCCCCCCACTCTCCACCCCGCCGCCACCGGCCATGTGG
 443 T  E  E  A  G  A  T  A  E  A  Q  E  S  G  I  R  N  K  S  S
1621 ACAGAGGAAGCCGGGGCGACCGCCGAGGCCCAGGAATCCGGCATCAGGAACAAGTCTAGC
 463 S  S  S  Q  I  P  V  V  G  V  V  T  E  D  D  E  A  Q  D  S
1681 AGTTCCAGTCAAATCCCGGTGGTTGGGGTGGTGACGGAGGACGATGAGGCGCAGGATTCC
 483 I  D  P  P  E  S  P  D  R  A  L  K  A  A  N  S  W  R  N  P
1741 ATTGATCCCCCAGAGAGCCCTGATCGTGCCTTAAAAGCCGCGAATTCCTGGAGGAACCCT
 503 V  L  P  H  T  N  G  V  G  P  L  W  E  F  L  L  R  L  L  K
1801 GTCCTGCCTCACACTAATGGTGTGGGGCCACTGTGGGAATTCCTGTTGAGGCTTCTCAAA
 523 S  Q  A  A  S  G  T  L  S  L  A  F  T  S  W  S  L  G  E  F
1861 TCTCAGGCTGCGTCAGGAACCCTGTCTCTTGCGTTCACATCCTGGAGCCTTGGAGAGTTC
 543 L  G  S  G  T  W  M  K  L  E  T  I  I  L  S  K  L  T  Q  E
1921 CTTGGGAGTGGGACATGGATGAAGCTGGAAACCATCATTCTCAGCAAACTAACACAGGAA
 563 Q  K  S  K  H  C  M  F  S  L  I  S  G  S  *
1981 CAGAAATCCAAACACTGCATGTTCTCACTGATAAGTGGGAGTTGAacaatgagaacacat
2041 ggacacagggaggggaacgtcacacaccagggcctgtcggggtgggaggcctagcaatt
2101 cattagaattacctgtgaagcttttaaaatgtaaggtttggatggaatgctcagaccta
2161 ccttagacccaattaagcccacagctttgagg
```

Figure 2U-1

The cDNA (SEQ ID. NO. : 42) and amino acid sequence (SEQ ID. NO. : 43) of 98P4B6 v.21. The start methionine is underlined. The open reading frame extends from nucleic acid 295-2025 including the stop codon.

```
   1 ggagaaaatttacagaaacccagagccaaaggtgctctcaggggatcccctgaaacattc
  61 aaagccattgcggccccagaagcttgggtaggcggggaagcagctggagtgcgaccgccg
 121 cggcagccaccctgcaaccgccagtcggaggtgcagtccgtaggccctggcccccgggtg
 181 ggcccttggggagtcggcgccgctcccggggagctgcaaggctcgccctgccggcgtg
   1                                                          M  E
 241 gagggcgcggggggcgcggaggatattcttggtgatcttggaagtgtccgtatcATGGAA
   3 S  I  S  M  M  G  S  P  K  S  L  S  E  T  F  L  P  N  G  I
 301 TCAATCTCTATGATGGGAAGCCCTAAGAGCCTTAGTGAAACTTTTTTACCTAATGGCATA
  23 N  G  I  K  D  A  R  K  V  T  V  G  V  I  G  S  G  D  F  A
 361 AATGGTATCAAAGATGCAAGGAAGGTCACTGTAGGTGTGATTGGAAGTGGAGATTTTGCC
  43 K  S  L  T  I  R  L  I  R  C  G  Y  H  V  V  I  G  S  R  N
 421 AAATCCTTGACCATTCGACTTATTAGATGCGGCTATCATGTGGTCATAGGAAGTAGAAAT
  63 P  K  F  A  S  E  F  F  P  H  V  V  D  V  T  H  E  D  A
 481 CCTAAGTTTGCTTCTGAATTTTTTCCTCATGTGGTAGATGTCACTCATCATGAAGATGCT
  83 L  T  K  T  N  I  I  F  V  A  I  H  R  E  H  Y  T  S  L  W
 541 CTCACAAAAACAAATATAATATTTGTTGCTATACACAGAGAACATTATACCTCCCTGTGG
 103 D  L  R  H  L  L  V  G  K  I  L  I  D  V  S  N  N  M  R  I
 601 GACCTGAGACATCTGCTTGTGGGTAAAATCCTGATTGATGTGAGCAATAACATGAGGATA
 123 N  Q  Y  P  E  S  N  A  E  Y  L  A  S  L  F  P  D  S  L  I
 661 AACCAGTACCCAGAATCCAATGCTGAATATTTGGCTTCATTATTCCCAGATTCTTTGATT
 143 V  K  G  F  N  V  V  S  A  W  A  L  Q  L  G  P  K  D  A  S
 721 GTCAAAGGATTTAATGTTGTCTCAGCTTGGGCACTTCAGTTAGGACCTAAGGATGCCAGC
 163 R  Q  V  Y  I  C  S  N  N  I  Q  A  R  Q  Q  V  I  E  L  A
 781 CGGCAGGTTTATATATGCAGCAACAATATTCAAGCGCGACAACAGGTTATTGAACTTGCC
 183 R  Q  L  N  F  I  P  I  D  L  G  S  L  S  S  A  R  E  I  E
 841 CGCCAGTTGAATTTCATTCCCATTGACTTGGGATCCTTATCATCAGCCAGAGAGATTGAA
 203 N  L  P  L  R  L  F  T  L  W  R  G  P  V  V  V  A  I  S  L
 901 AATTTACCCCTACGACTCTTTACTCTCTGGAGAGGGCCAGTGGTGGTAGCTATAAGCTTG
 223 A  T  F  F  L  Y  S  F  V  R  D  V  I  H  P  Y  A  R  N
 961 GCCACATTTTTTTTCCTTTATTCCTTTGTCAGAGATGTGATTCATCCATATGCTAGAAAC
 243 Q  Q  S  D  F  Y  K  I  P  I  E  I  V  N  K  T  L  P  I  V
1021 CAACAGAGTGACTTTTACAAAATTCCTATAGAGATTGTGAATAAAACCTTACCTATAGTT
 263 A  I  T  L  L  S  L  V  Y  L  A  G  L  L  A  A  A  Y  Q  L
1081 GCCATTACTTTGCTCTCCCTAGTATACCTCGCAGGTCTTCTGGCAGCTGCTTATCAACTT
 283 Y  Y  G  T  K  Y  R  R  F  P  P  W  L  E  T  W  L  Q  C  R
```

Figure 2U-2

```
1141 TATTACGGCACCAAGTATAGGAGATTTCCACCTTGGTTGGAAACCTGGTTACAGTGTAGA
 303 K  Q  L  G  L  L  S  F  F  F  A  M  V  H  V  A  Y  S  L  C
1201 AAACAGCTTGGATTACTAAGTTTTTTCTTCGCTATGGTCCATGTTGCCTACAGCCTCTGC
 323 L  P  M  R  R  S  E  R  Y  L  F  L  N  M  A  Y  Q  Q  S  T
1261 TTACCGATGAGAAGGTCAGAGAGATATTTGTTTCTCAACATGGCTTATCAGCAGTCTACA
 343 L  G  Y  V  A  L  L  I  S  T  F  H  V  L  I  Y  G  W  K  R
1321 CTTGGATATGTCGCTCTGCTCATAAGTACTTTCCATGTTTTAATTTATGGATGGAAACGA
 363 A  F  E  E  Y  Y  R  F  Y  T  P  P  N  F  V  L  A  L  V
1381 GCTTTTGAGGAAGAGTACTACAGATTTTATACACCACCAAACTTTGTTCTTGCTCTTGTT
 383 L  P  S  I  V  I  L  D  L  S  V  E  V  L  A  S  P  A  A  A
1441 TTGCCCTCAATTGTAATTCTGGATCTGTCTGTGGAGGTTCTGGCTTCCCCAGCTGCTGCC
 403 W  K  C  L  G  A  N  I  L  R  G  G  L  S  E  I  V  L  P  I
1501 TGGAAATGCTTAGGTGCTAATATCCTGAGAGGAGGATTGTCAGAGATAGTACTCCCCATA
 423 E  W  Q  Q  D  R  K  I  P  P  L  S  T  P  P  P  P  A  M  W
1561 GAGTGGCAGCAGGACAGGAAGATCCCCCCACTCTCCACCCCGCCGCCACCGGCCATGTGG
 443 T  E  E  A  G  A  T  A  E  A  Q  E  S  G  I  R  N  K  S  S
1621 ACAGAGGAAGCCGGGGCGACCGCCGAGGCCCAGGAATCCGGCATCAGGAACAAGTCTAGC
 463 S  S  S  Q  I  P  V  V  G  V  V  T  E  D  D  E  A  Q  D  S
1681 AGTTCCAGTCAAATCCCGGTGGTTGGGGTGGTGACGGAGGACGATGAGGCGCAGGATTCC
 483 I  D  P  P  E  S  P  D  R  A  L  K  A  A  N  S  W  R  N  P
1741 ATTGATCCCCCAGAGAGCCCTGATCGTGCCTTAAAAGCCGCGAATTCCTGGAGGAACCCT
 503 V  L  P  H  T  N  G  V  G  P  L  W  E  F  L  L  R  L  L  K
1801 GTCCTGCCTCACACTAATGGTGTGGGCCACTGTGGGAATTCCTGTTGAGGCTTCTCAAA
 523 S  Q  A  A  S  G  T  L  S  L  A  F  T  S  W  S  L  G  E  F
1861 TCTCAGGCTGCGTCAGGAACCCTGTCTCTTGCGTTCACATCCTGGAGCCTTGGAGAGTTC
 543 L  G  S  G  T  W  M  K  L  E  T  I  I  L  S  K  L  T  Q  E
1921 CTTGGGAGTGGGACATGGATGAAGCTGGAAACCATAATTCTCAGCAAACTAACACAGGAA
 563 Q  K  T  K  H  C  M  F  S  L  I  S  G  S  *
1981 CAGAAAACCAAACACTGCATGTTCTCACTGATAAGTGGGAGTTGAacaatgagaacacat
2041 ggacacagggaggggaacgtcacacaccagggcctgtcgggggtgggaggcctagcaatt
2101 cattgaattacctgtgaagcttttaaaatgtaaggtttggatggaatgctcagaccta
2161 ccttagacccaattaagcccacagctttgagg
```

Figure 2V-1

The cDNA (SEQ ID. NO. : 44) and amino acid sequence (SEQ ID. NO. : 45) of 98P4B6 v.22. The start methionine is underlined. The open reading frame extends from nucleic acid 295-2025 including the stop codon.

```
   1 ggagaaaatttacagaaacccagagccaaaggtgctctcaggggatcccctgaaacattc
  61 aaagccattgcggccccagaagcttgggtaggcggggaagcagctggagtgcgaccgccg
 121 cggcagccaccctgcaaccgccagtcggaggtgcagtccgtaggccctggcccccgggtg
 181 ggccttggggagtcggcgccgctcccggggagctgcaaggctcgcccctgcccggcgtg
   1                                                            M  E
 241 gagggcgcggggggcgcggaggatattcttggtgatcttggaagtgtccgtatcATGGAA
   3 S  I  S  M  M  G  S  P  K  S  L  S  E  T  F  L  P  N  G  I
 301 TCAATCTCTATGATGGGAAGCCCTAAGAGCCTTAGTGAAACTTTTTTACCTAATGGCATA
  23 N  G  I  K  D  A  R  K  V  T  G  V  I  G  S  G  D  F  A
 361 AATGGTATCAAAGATGCAAGGAAGGTCACTGTAGGTGTGATTGGAAGTGGAGATTTTGCC
  43 K  S  L  T  I  R  L  I  R  C  G  Y  H  V  V  I  G  S  R  N
 421 AAATCCTTGACCATTCGACTTATTAGATGCGGCTATCATGTGGTCATAGGAAGTAGAAAT
  63 P  K  F  A  S  E  F  F  P  H  V  V  D  V  T  H  H  E  D  A
 481 CCTAAGTTTGCTTCTGAATTTTTTCCTCATGTGGTAGATGTCACTCATCATGAAGATGCT
  83 L  T  K  T  N  I  I  F  V  A  I  H  R  E  H  Y  T  S  L  W
 541 CTCACAAAAACAAATATAATATTTGTTGCTATACACAGAGAACATTATACCTCCCTGTGG
 103 D  L  R  H  L  L  V  G  K  I  L  I  D  V  S  N  N  M  R  I
 601 GACCTGAGACATCTGCTTGTGGGTAAAATCCTGATTGATGTGAGCAATAACATGAGGATA
 123 N  Q  Y  P  E  S  N  A  E  Y  L  A  S  L  F  P  D  S  L  I
 661 AACCAGTACCCAGAATCCAATGCTGAATATTTGGCTTCATTATTCCCAGATTCTTTGATT
 143 V  K  G  F  N  V  V  S  A  W  A  L  Q  L  G  P  K  D  A  S
 721 GTCAAAGGATTTAATGTTGTCTCAGCTTGGGCACTTCAGTTAGGACCTAAGGATGCCAGC
 163 R  Q  V  Y  I  C  S  N  N  I  Q  A  R  Q  Q  V  I  E  L  A
 781 CGGCAGGTTTATATATGCAGCAACAATATTCAAGCGCGACAACAGGTTATTGAACTTGCC
 183 R  Q  L  N  F  I  P  I  D  L  G  S  L  S  S  A  R  E  I  E
 841 CGCCAGTTGAATTTCATTCCCATTGACTTGGGATCCTTATCATCAGCCAGAGAGATTGAA
 203 N  L  P  L  R  L  F  T  L  W  R  G  P  V  V  V  A  I  S  L
 901 AATTTACCCCTACGACTCTTTACTCTCTGGAGAGGGCCAGTGGTGGTAGCTATAAGCTTG
 223 A  T  F  F  L  Y  S  F  V  R  D  V  I  H  P  Y  A  R  N
 961 GCCACATTTTTTTTCCTTTATTCCTTTGTCAGAGATGTGATTCATCCATATGCTAGAAAC
 243 Q  Q  S  D  F  Y  K  I  P  I  E  I  V  N  K  T  L  P  I  V
1021 CAACAGAGTGACTTTTACAAAATTCCTATAGAGATTGTGAATAAAACCTTACCTATAGTT
 263 A  I  T  L  L  S  L  V  Y  L  A  G  L  L  A  A  A  Y  Q  L
1081 GCCATTACTTTGCTCTCCCTAGTATACCTCGCAGGTCTTCTGGCAGCTGCTTATCAACTT
 283 Y  Y  G  T  K  Y  R  R  F  P  P  W  L  E  T  W  L  Q  C  R
```

Figure 2V-2

```
1141 TATTACGGCACCAAGTATAGGAGATTTCCACCTTGGTTGGAAACCTGGTTACAGTGTAGA
 303  K  Q  L  G  L  L  S  F  F  F  A  M  V  H  V  A  Y  S  L  C
1201 AAACAGCTTGGATTACTAAGTTTTTTCTTCGCTATGGTCCATGTTGCCTACAGCCTCTGC
 323  L  P  M  R  R  S  E  R  Y  L  F  L  N  M  A  Y  Q  Q  S  T
1261 TTACCGATGAGAAGGTCAGAGAGATATTTGTTTCTCAACATGGCTTATCAGCAGTCTACA
 343  L  G  Y  V  A  L  L  I  S  T  F  H  V  L  I  Y  G  W  K  R
1321 CTTGGATATGTCGCTCTGCTCATAAGTACTTTCCATGTTTTAATTTATGGATGGAAACGA
 363  A  F  E  E  E  Y  Y  R  F  Y  T  P  P  N  F  V  L  A  L  V
1381 GCTTTTGAGGAAGAGTACTACAGATTTTATACACCACCAAACTTTGTTCTTGCTCTTGTT
 383  L  P  S  I  V  I  L  D  L  S  V  E  V  L  A  S  P  A  A  A
1441 TTGCCCTCAATTGTAATTCTGGATCTGTCTGTGGAGGTTCTGGCTTCCCCAGCTGCTGCC
 403  W  K  C  L  G  A  N  I  L  R  G  G  L  S  E  I  V  L  P  I
1501 TGGAAATGCTTAGGTGCTAATATCCTGAGAGGAGGATTGTCAGAGATAGTACTCCCCATA
 423  E  W  Q  Q  D  R  K  I  P  P  L  S  T  P  P  P  P  A  M  W
1561 GAGTGGCAGCAGGACAGGAAGATCCCCCCACTCTCCACCCCGCCGCCACCGGCCATGTGG
 443  T  E  E  A  G  A  T  A  E  A  Q  E  S  G  I  R  N  K  S  S
1621 ACAGAGGAAGCCGGGGCGACCGCCGAGGCCCAGGAATCCGGCATCAGGAACAAGTCTAGC
 463  S  S  S  Q  I  P  V  V  G  V  V  T  E  D  D  E  A  Q  D  S
1681 AGTTCCAGTCAAATCCCGGTGGTTGGGGTGGTGACGGAGGACGATGAGGCGCAGGATTCC
 483  I  D  P  P  E  S  P  D  R  A  L  K  A  A  N  S  W  R  N  P
1741 ATTGATCCCCCAGAGAGCCCTGATCGTGCCTTAAAAGCCGCGAATTCCTGGAGGAACCCT
 503  V  L  P  H  T  N  G  V  G  P  L  W  E  F  L  L  R  L  L  K
1801 GTCCTGCCTCACACTAATGGTGTGGGGCCACTGTGGGAATTCCTGTTGAGGCTTCTCAAA
 523  S  Q  A  A  S  G  T  L  S  L  A  F  T  S  W  S  L  G  E  F
1861 TCTCAGGCTGCGTCAGGAACCCTGTCTCTTGCGTTCACATCCTGGAGCCTTGGAGAGTTC
 543  L  G  S  G  T  W  M  K  L  E  T  I  I  L  S  K  L  T  Q  E
1921 CTTGGGAGTGGGACATGGATGAAGCTGGAAACCATAATTCTCAGCAAACTAACACAGGAA
 563  Q  K  S  K  H  C  M  F  S  L  I  S  G  S  *
1981 CAGAAATCCAAACACTGCATGTTCTCACTCATAAGTGGGAGTTGAacaatgagaacacat
2041 ggacacagggaggggaacgtcacacaccagggcctgtcgggggtgggaggcctagcaatt
2101 cattagaattacctgtgaagcttttaaaatgtaaggtttggatggaatgctcagaccta
2161 ccttagacccaattaagcccacagctttgagg
```

Figure 2W-1

The cDNA (SEQ ID. NO. : 46) and amino acid sequence (SEQ ID. NO. : 47) of 98P4B6 v.23. The start methionine is underlined. The open reading frame extends from nucleic acid 295-2025 including the stop codon.

```
   1 ggagaaaatttacagaaacccagagccaaaggtgctctcaggggatcccctgaaacattc
  61 aaagccattgcggccccagaagcttgggtaggcggggaagcagctggagtgcgaccgccg
 121 cggcagccaccctgcaaccgccagtcggaggtgcagtccgtaggccctggccccgggtg
 181 ggccttggggagtcggcgccgctcccggggagctgcaaggctcgccctgccggcgtg
   1                                                            M  E
 241 gagggcgcggggggcgcggaggatattcttggtgatcttggaagtgtccgtatcATGGAA
   3 S  I  S  M  M  G  S  P  K  S  L  S  E  T  F  L  P  N  G  I
 301 TCAATCTCTATGATGGGAAGCCCTAAGAGCCTTAGTGAAACTTTTTTACCTAATGGCATA
  23 N  G  I  K  D  A  R  K  V  T  V  G  V  I  G  S  G  D  F  A
 361 AATGGTATCAAAGATGCAAGGAAGGTCACTGTAGGTGTGATTGGAAGTGGAGATTTTGCC
  43 K  S  L  T  I  R  L  I  R  C  G  Y  H  V  V  I  G  S  R  N
 421 AAATCCTTGACCATTCGACTTATTAGATGCGGCTATCATGTGGTCATAGGAAGTAGAAAT
  63 P  K  F  A  S  E  F  F  P  H  V  V  D  V  T  H  H  E  D  A
 481 CCTAAGTTTGCTTCTGAATTTTTTCCTCATGTGGTAGATGTCACTCATCATGAAGATGCT
  83 L  T  K  T  N  I  I  F  V  A  I  H  R  E  H  Y  T  S  L  W
 541 CTCACAAAAACAAATATAATATTTGTTGCTATACACAGAGAACATTATACCTCCCTGTGG
 103 D  L  R  H  L  L  V  G  K  I  L  I  D  V  S  N  N  M  R  I
 601 GACCTGAGACATCTGCTTGTGGGTAAAATCCTGATTGATGTGAGCAATAACATGAGGATA
 123 N  Q  Y  P  E  S  N  A  E  Y  L  A  S  L  F  P  D  S  L  I
 661 AACCAGTACCCAGAATCCAATGCTGAATATTTGGCTTCATTATTCCCAGATTCTTTGATT
 143 V  K  G  F  N  V  V  S  A  W  A  L  Q  L  G  P  K  D  A  S
 721 GTCAAAGGATTTAATGTTGTCTCAGCTTGGGCACTTCAGTTAGGACCTAAGGATGCCAGC
 163 R  Q  V  Y  I  C  S  N  N  I  Q  A  R  Q  Q  V  I  E  L  A
 781 CGGCAGGTTTATATATGCAGCAACAATATTCAAGCGCGACAACAGGTTATTGAACTTGCC
 183 R  Q  L  N  F  I  P  I  D  L  G  S  L  S  S  A  R  E  I  E
 841 CGCCAGTTGAATTTCATTCCCATTGACTTGGGATCCTTATCATCAGCCAGAGAGATTGAA
 203 N  L  P  L  R  L  F  T  L  W  R  G  P  V  V  V  A  I  S  L
 901 AATTTACCCCTACGACTCTTTACTCTCTGGAGAGGGCCAGTGGTGGTAGCTATAAGCTTG
 223 A  T  F  F  F  L  Y  S  F  V  R  D  V  I  H  P  Y  A  R  N
 961 GCCACATTTTTTTTCCTTTATTCCTTTGTCAGAGATGTGATTCATCCATATGCTAGAAAC
 243 Q  Q  S  D  F  Y  K  I  P  I  E  I  V  N  K  T  L  P  I  V
1021 CAACAGAGTGACTTTTACAAAATTCCTATAGAGATTGTGAATAAAACCTTACCTATAGTT
 263 A  I  T  L  L  S  L  V  Y  L  A  G  L  L  A  A  A  Y  Q  L
1081 GCCATTACTTTGCTCTCCCTAGTATACCTCGCAGGTCTTCTGGCAGCTGCTTATCAACTT
 283 Y  Y  G  T  K  Y  R  R  F  P  P  W  L  E  T  W  L  Q  C  R
```

Figure 2W-2

```
1141 TATTACGGCACCAAGTATAGGAGATTTCCACCTTGGTTGGAAACCTGGTTACAGTGTAGA
 303 K  Q  L  G  L  L  S  F  F  F  A  M  V  H  V  A  Y  S  L  C
1201 AAACAGCTTGGATTACTAAGTTTTTTCTTCGCTATGGTCCATGTTGCCTACAGCCTCTGC
 323 L  P  M  R  R  S  E  R  Y  L  F  L  N  M  A  Y  Q  Q  S  T
1261 TTACCGATGAGAAGGTCAGAGAGATATTTGTTTCTCAACATGGCTTATCAGCAGTCTACA
 343 L  G  Y  V  A  L  L  I  S  T  F  H  V  L  I  Y  G  W  K  R
1321 CTTGGATATGTCGCTCTGCTCATAAGTACTTTCCATGTTTTAATTTATGGATGGAAACGA
 363 A  F  E  E  Y  Y  R  F  Y  T  P  P  N  F  V  L  A  L  V
1381 GCTTTTGAGGAAGAGTACTACAGATTTTATACACCACCAAACTTTGTTCTTGCTCTTGTT
 383 L  P  S  I  V  I  L  D  L  S  V  E  V  L  A  S  P  A  A  A
1441 TTGCCCTCAATTGTAATTCTGGATCTGTCTGTGGAGGTTCTGGCTTCCCCAGCTGCTGCC
 403 W  K  C  L  G  A  N  I  L  R  G  G  L  S  E  I  V  L  P  I
1501 TGGAAATGCTTAGGTGCTAATATCCTGAGAGGAGGATTGTCAGAGATAGTACTCCCCATA
 423 E  W  Q  Q  D  R  K  I  P  P  L  S  T  P  P  P  P  A  M  W
1561 GAGTGGCAGCAGGACAGGAAGATCCCCCCACTCTCCACCCCGCCGCCACCGGCCATGTGG
 443 T  E  E  A  G  A  T  A  E  A  Q  E  S  G  I  R  N  K  S  S
1621 ACAGAGGAAGCCGGGGCGACCGCCGAGGCCCAGGAATCCGGCATCAGGAACAAGTCTAGC
 463 S  S  S  Q  I  P  V  V  G  V  V  T  E  D  D  E  A  Q  D  S
1681 AGTTCCAGTCAAATCCCGGTGGTTGGGGTGGTGACGGAGGACGATGAGGCGCAGGATTCC
 483 I  D  P  P  E  S  P  D  R  A  L  K  A  A  N  S  W  R  N  P
1741 ATTGATCCCCCAGAGAGCCCTGATCGTGCCTTAAAAGCCGCGAATTCCTGGAGGAACCCT
 503 V  L  P  H  T  N  G  V  G  P  L  W  E  F  L  L  R  L  L  K
1801 GTCCTGCCTCACACTAATGGTGTGGGGCCACTGTGGGAATTCCTGTTGAGGCTTCTCAAA
 523 S  Q  A  A  S  G  T  L  S  L  A  F  T  S  W  S  L  G  E  F
1861 TCTCAGGCTGCGTCAGGAACCCTGTCTCTTGCGTTCACATCCTGGAGCCTTGGAGAGTTC
 543 L  G  S  G  T  W  M  K  L  E  T  I  I  L  S  K  L  T  Q  E
1921 CTTGGGAGTGGGACATGGATGAAGCTGGAAACCATAATTCTCAGCAAACTAACACAGGAA
 563 Q  K  S  K  H  C  M  F  S  L  I  S  G  S  *
1981 CAGAAATCCAAACACTGCATGTTCTCACTTATAAGTGGGAGTTGAacaatgagaacacat
2041 ggacacagggaggggaacgtcacacaccagggcctgtcgggggtgggaggcctagcaatt
2101 cattagaattacctgtgaagcttttaaaatgtaaggtttggatggaatgctcagaccta
2161 ccttagacccaattaagcccacagctttgagg
```

Figure 2X-1

The cDNA (SEQ ID. NO. : 48) and amino acid sequence (SEQ ID. NO. : 49) of 98P4B6 v.24. The start methionine is underlined. The open reading frame extends from nucleic acid 295-2025 including the stop codon.

```
   1 ggagaaaatttacagaaacccagagccaaaggtgctctcaggggatcccctgaaacattc
  61 aaagccattgcggccccagaagcttgggtaggcggggaagcagctggagtgcgaccgccg
 121 cggcagccaccctgcaaccgccagtcggaggtgcagtccgtaggccctggcccccgggtg
 181 ggccttggggagtcggcgccgctcccggggagctgcaaggctcgccctgccggcgtg
   1                                                          M  E
 241 gagggcgcggggggcgcggaggatattcttggtgatcttggaagtgtccgtatcATGGAA
   3 S  I  S  M  M  G  S  P  K  S  L  S  E  T  F  L  P  N  G  I
 301 TCAATCTCTATGATGGGAAGCCCTAAGAGCCTTAGTGAAACTTTTTTACCTAATGGCATA
  23 N  G  I  K  D  A  R  K  V  T  V  G  V  I  G  S  G  D  F  A
 361 AATGGTATCAAAGATGCAAGGAAGGTCACTGTAGGTGTGATTGGAAGTGGAGATTTTGCC
  43 K  S  L  T  I  R  L  I  R  C  G  Y  H  V  V  I  G  S  R  N
 421 AAATCCTTGACCATTCGACTTATTAGATGCGGCTATCATGTGGTCATAGGAAGTAGAAAT
  63 P  K  F  A  S  E  F  F  P  H  V  V  D  V  T  H  H  E  D  A
 481 CCTAAGTTTGCTTCTGAATTTTTTCCTCATGTGGTAGATGTCACTCATCATGAAGATGCT
  83 L  T  K  T  N  I  I  F  V  A  I  H  R  E  H  Y  T  S  L  W
 541 CTCACAAAAACAAATATAATATTTGTTGCTATACACAGAGAACATTATACCTCCCTGTGG
 103 D  L  R  H  L  L  V  G  K  I  L  I  D  V  S  N  N  M  R  I
 601 GACCTGAGACATCTGCTTGTGGGTAAAATCCTGATTGATGTGAGCAATAACATGAGGATA
 123 N  Q  Y  P  E  S  N  A  E  Y  L  A  S  L  F  P  D  S  L  I
 661 AACCAGTACCCAGAATCCAATGCTGAATATTTGGCTTCATTATTCCCAGATTCTTTGATT
 143 V  K  G  F  N  V  V  S  A  W  A  L  Q  L  G  P  K  D  A  S
 721 GTCAAAGGATTTAATGTTGTCTCAGCTTGGGCACTTCAGTTAGGACCTAAGGATGCCAGC
 163 R  Q  V  Y  I  C  S  N  N  I  Q  A  R  Q  Q  V  I  E  L  A
 781 CGGCAGGTTTATATATGCAGCAACAATATTCAAGCGCGACAACAGGTTATTGAACTTGCC
 183 R  Q  L  N  F  I  P  I  D  L  G  S  L  S  S  A  R  E  I  E
 841 CGCCAGTTGAATTTCATTCCCATTGACTTGGGATCCTTATCATCAGCCAGAGAGATTGAA
 203 N  L  P  L  R  L  F  T  L  W  R  G  P  V  V  V  A  I  S  L
 901 AATTTACCCCTACGACTCTTTACTCTCTGGAGAGGGCCAGTGGTGGTAGCTATAAGCTTG
 223 A  T  F  F  F  L  Y  S  F  V  R  D  V  I  H  P  Y  A  R  N
 961 GCCACATTTTTTTTCCTTTATTCCTTTGTCAGAGATGTGATTCATCCATATGCTAGAAAC
 243 Q  Q  S  D  F  Y  K  I  P  I  E  I  V  N  K  T  L  P  I  V
1021 CAACAGAGTGACTTTTACAAAATTCCTATAGAGATTGTGAATAAAACCTTACCTATAGTT
 263 A  I  T  L  L  S  L  V  Y  L  A  G  L  L  A  A  A  Y  Q  L
1081 GCCATTACTTTGCTCTCCCTAGTATACCTCGCAGGTCTTCTGGCAGCTGCTTATCAACTT
 283 Y  Y  G  T  K  Y  R  R  F  P  P  W  L  E  T  W  L  Q  C  R
```

Figure 2X-2

```
1141 TATTACGGCACCAAGTATAGGAGATTTCCACCTTGGTTGGAAACCTGGTTACAGTGTAGA
 303 K   Q   L   G   L   L   S   F   F   F   A   M   V   H   V   A   Y   S   L   C
1201 AAACAGCTTGGATTACTAAGTTTTTTCTTCGCTATGGTCCATGTTGCCTACAGCCTCTGC
 323 L   P   M   R   R   S   E   R   Y   L   F   L   N   M   A   Y   Q   Q   S   T
1261 TTACCGATGAGAAGGTCAGAGAGATATTTGTTTCTCAACATGGCTTATCAGCAGTCTACA
 343 L   G   Y   V   A   L   L   I   S   T   F   H   V   L   I   Y   G   W   K   R
1321 CTTGGATATGTCGCTCTGCTCATAAGTACTTTCCATGTTTTAATTTATGGATGGAAACGA
 363 A   F   E   E   Y   Y   R   F   Y   T   P   P   N   F   V   L   A   L   V
1381 GCTTTTGAGGAAGAGTACTACAGATTTTATACACCACCAAACTTTGTTCTTGCTCTTGTT
 383 L   P   S   I   V   I   L   D   L   S   V   E   V   L   A   S   P   A   A   A
1441 TTGCCCTCAATTGTAATTCTGGATCTGTCTGTGGAGGTTCTGGCTTCCCCAGCTGCTGCC
 403 W   K   C   L   G   A   N   I   L   R   G   G   L   S   E   I   V   L   P   I
1501 TGGAAATGCTTAGGTGCTAATATCCTGAGAGGAGGATTGTCAGAGATAGTACTCCCCATA
 423 E   W   Q   Q   D   R   K   I   P   P   L   S   T   P   P   P   P   A   M   W
1561 GAGTGGCAGCAGGACAGGAAGATCCCCCCACTCTCCACCCCGCCGCCACCGGCCATGTGG
 443 T   E   E   A   G   A   T   A   E   A   Q   E   S   G   I   R   N   K   S   S
1621 ACAGAGGAAGCCGGGGCGACCGCCGAGGCCCAGGAATCCGGCATCAGGAACAAGTCTAGC
 463 S   S   S   Q   I   P   V   V   G   V   V   T   E   D   D   E   A   Q   D   S
1681 AGTTCCAGTCAAATCCCGGTGGTTGGGGTGGTGACGGAGGACGATGAGGCGCAGGATTCC
 483 I   D   P   P   E   S   P   D   R   A   L   K   A   A   N   S   W   R   N   P
1741 ATTGATCCCCCAGAGAGCCCTGATCGTGCCTTAAAAGCCGCGAATTCCTGGAGGAACCCT
 503 V   L   P   H   T   N   G   V   G   P   L   W   E   F   L   L   R   L   L   K
1801 GTCCTGCCTCACACTAATGGTGTGGGCCACTGTGGGAATTCCTGTTGAGGCTTCTCAAA
 523 S   Q   A   A   S   G   T   L   S   L   A   F   T   S   W   S   L   G   E   F
1861 TCTCAGGCTGCGTCAGGAACCCTGTCTCTTGCGTTCACATCCTGGAGCCTTGGAGAGTTC
 543 L   G   S   G   T   W   M   K   L   E   T   I   I   L   S   K   L   T   Q   E
1921 CTTGGGAGTGGACATGGATGAAGCTGGAAACCATAATTCTCAGCAAACTAACACAGGAA
 563 Q   K   S   K   H   C   M   F   S   L   I   S   G   S   *
1981 CAGAAATCCAAACACTGCATGTTCTCACTGATAAGTGGGAGTTGAacaatgagaacacat
2041 ggacacagggaggggaacatcacacaccagggcctgtcgggggtgggaggcctagcaatt
2101 cattagaattacctgtgaagcttttaaaatgtaaggtttggatggaatgctcagaccta
2161 ccttagacccaattaagcccacagctttgagg
```

Figure 2Y-1

The cDNA (SEQ ID. NO. : 50) and amino acid sequence (SEQ ID. NO. : 51) of 98P4B6 v.25. The start methionine is underlined. The open reading frame extends from nucleic acid 394-1866 including the stop codon.

```
   1 gcccccctccgagctccccgactcctccccgcgctccacggctcttcccgactccagtcag
  61 cgttcctcgggccctcggcgccacaagctgtccgggcacgcagcccctagcggcgcgtcg
 121 ctgccaagccggcctccgcgcgcctccctccttccttctccctggctgttcgcgatcca
 181 gcttgggtaggcggggaagcagctggagtgcgaccgccacggcagccaccctgcaaccgc
 241 cagtcggaggtgcagtccgtaggccctggccccgggtgggcccttggggagtcggcgcc
 301 gctcccgaggagctgcaaggctcgcccctgcccggcgtggagggcgcggggggcgcggag
   1                                              M  E  S  I  S  M  M  G  S
 361 gatattcttggtgatcttggaagtgtccgtatcATGGAATCAATCTCTATGATGGGAAGC
  10 P  K  S  L  S  E  T  C  L  P  N  G  I  N  G  I  K  D  A  R
 421 CCTAAGAGCCTTAGTGAAACTTGTTTACCTAATGGCATAAATGGTATCAAAGATGCAAGG
  30 K  V  T  V  G  V  I  G  S  G  D  F  A  K  S  L  T  I  R  L
 481 AAGGTCACTGTAGGTGTGATTGGAAGTGGAGATTTTGCCAAATCCTTGACCATTCGACTT
  50 I  R  C  G  Y  H  V  V  I  G  S  R  N  P  K  F  A  S  E  F
 541 ATTAGATGCGGCTATCATGTGGTCATAGGAAGTAGAAATCCTAAGTTTGCTTCTGAATTT
  70 F  P  H  V  V  D  V  T  H  H  E  D  A  L  T  K  T  N  I  I
 601 TTTCCTCATGTGGTAGATGTCACTCATCATGAAGATGCTCTCACAAAAACAAATATAATA
  90 F  V  A  I  H  R  E  H  Y  T  S  L  W  D  L  R  H  L  L  V
 661 TTTGTTGCTATACACAGAGAACATTATACCTCCCTGTGGGACCTGAGACATCTGCTTGTG
 110 G  K  I  L  I  D  V  S  N  N  M  R  I  N  Q  Y  P  E  S  N
 721 GGTAAAATCCTGATTGATGTGAGCAATAACATGAGGATAAACCAGTACCCAGAATCCAAT
 130 A  E  Y  L  A  S  L  F  P  D  S  L  I  V  K  G  F  N  V  V
 781 GCTGAATATTTGGCTTCATTATTCCCAGATTCTTTGATTGTCAAAGGATTTAATGTTGTC
 150 S  A  W  A  L  Q  L  G  P  K  D  A  S  R  Q  V  Y  I  C  S
 841 TCAGCTTGGGCACTTCAGTTAGGACCTAAGGATGCCAGCCGGCAGGTTTATATATGCAGC
 170 N  N  I  Q  A  R  Q  Q  V  I  E  L  A  R  Q  L  N  F  I  P
 901 AACAATATTCAAGCGCGACAACAGGTTATTGAACTTGCCCGCCAGTTGAATTTCATTCCC
 190 I  D  L  G  S  L  S  S  A  R  E  I  E  N  L  P  L  R  L  F
 961 ATTGACTTGGGATCCTTATCATCAGCCAGAGAGATTGAAAATTTACCCCTACGACTCTTT
 210 T  L  W  R  G  P  V  V  V  A  I  S  L  A  T  F  F  F  L  Y
1021 ACTCTCTGGAGAGGGCCAGTGGTGGTAGCTATAAGCTTGGCCACATTTTTTTTCCTTTAT
 230 S  F  V  R  D  V  I  H  P  Y  A  R  N  Q  Q  S  D  F  Y  K
1081 TCCTTTGTCAGAGATGTGATTCATCCATATGCTAGAAACCAACAGAGTGACTTTTACAAA
 250 I  P  I  E  I  V  N  K  T  L  P  I  V  A  I  T  L  L  S  L
1141 ATTCCTATAGAGATTGTGAATAAAACCTTACCTATAGTTGCCATTACTTTGCTCTCCCTA
 270 V  Y  L  A  G  L  L  A  A  A  Y  Q  L  Y  Y  G  T  K  Y  R
```

Figure 2Y-2

```
1201 GTATACCTTGCAGGTCTTCTGGCAGCTGCTTATCAACTTTATTACGGCACCAAGTATAGG
 290 R   F   P   P   W   L   E   T   W   L   Q   C   R   K   Q   L   G   L   L   S
1261 AGATTTCCACCTTGGTTGGAAACCTGGTTACAGTGTAGAAAACAGCTTGGATTACTAAGT
 310 F   F   F   A   M   V   H   V   A   Y   S   L   C   L   P   M   R   R   S   E
1321 TTTTTCTTCGCTATGGTCCATGTTGCCTACAGCCTCTGCTTACCGATGAGAAGGTCAGAG
 330 R   Y   L   F   L   N   M   A   Y   Q   Q   V   H   A   N   I   E   N   S   W
1381 AGATATTTGTTTCTCAACATGGCTTATCAGCAGGTTCATGCAAATATTGAAAACTCTTGG
 350 N   E   E   V   W   R   I   E   M   Y   I   S   F   G   I   M   S   L   G
1441 AATGAGGAAGAAGTTTGGAGAATTGAAATGTATATCTCCTTTGGCATAATGAGCCTTGGC
 370 L   L   S   L   L   A   V   T   S   I   P   S   V   S   N   A   L   N   W   R
1501 TTACTTTCCCTCCTGGCAGTCACTTCTATCCCTTCAGTGAGCAATGCTTTAAACTGGAGA
 390 E   F   S   F   I   Q   S   T   L   G   Y   V   A   L   L   I   S   T   F   H
1561 GAATTCAGTTTTATTCAGTCTACACTTGGATATGTCGCTCTGCTCATAAGTACTTTCCAT
 410 V   L   I   Y   G   W   K   R   A   F   E   E   E   Y   Y   R   F   Y   T   P
1621 GTTTTAATTTATGGATGGAAACGAGCTTTTGAGGAAGAGTACTACAGATTTTATACACCA
 430 P   N   F   V   L   A   L   V   L   P   S   I   V   I   L   G   K   I   I   L
1681 CCAAACTTTGTTCTTGCTCTTGTTTTGCCCTCAATTGTAATTCTGGGTAAGATTATTTTA
 450 F   L   P   C   I   S   Q   K   L   K   R   I   K   K   G   W   E   K   S   Q
1741 TTCCTTCCATGTATAAGCCAAAAGCTAAAACGAATTAAAAAAGGCTGGGAAAAGAGCCAA
 470 F   L   E   E   G   M   G   G   T   I   P   H   V   S   P   E   R   V   T   V
1801 TTTCTGGAAGAAGGTATGGGAGGAACAATTCCTCATGTCTCCCCGGAGAGGGTCACAGTA
 490 M   *
1861 ATGTGAtgacaaatggtgttcacagctgccatataaagttctactcatgccattatttt
1921 atgacttctacgttcagttacaagtatgctgtcaaattatcgtgggttgaaacttgttaa
1981 atgagatttcaactgacttagtgatagagttttcttcaagttaattttcacaaatgtcat
2041 gtttgccaatatgaattttctagtcaacatattattgtaatttaggtatgttttgtttt
2101 gttttgcacaactgtaaccctgttgttactttatatttcataatcaggcaaaaatactta
2161 cagttaataatatagatataatgttaaaaacaatttgcaaaccagcagaattttaagctt
2221 ttaaaataattcaatggatatacattttttctgaagattaagattttaattattcaact
2281 taaaaagtagaaatgcattattatacattttttaagaaaggacacgttatgttagcatc
2341 taggtaaggctgcatgatagcattcctatatttctctcataaaataggatttgaaggatg
2401 aaattaattgtatgaagcaatgtgattatatgaagagacacaaattaaaaagacaaatta
2461 aacctgaaattatatttaaaatatatttgagacatgaatacatactgataatacatacc
2521 tcatgaaagatttattctttattgtgttacagagcagtttcattttcatattaatatac
2581 tgatcaggaagaggattcagtaacatttggcttccaaaactgctatctctaatacggtac
2641 caatcctaggaactgtatactagttcctacttagaacaaaagtatcaagtttgcacacaa
2701 gtaatctgccagctgacctttgtcgcaccttaaccagtcaccacttgctatggtatagga
2761 ttatactgatgttctttgagggattctgatgtgctaggcatggttctaagtactttactt
```

Figure 2Y-3

```
2821 gtattatcccatttaatacttagaacaacccgtgagataagtagttattatcctcattt
2881 tacacatgagggaccgaaggatagaaaagttattttcaaaggtcttgcagttaataaat
2941 ggcagagtgagcattcaagtccaggtagtcatattccagaggccacggttttaaccacta
3001 ggctctagagctcccgccgcgcccctatgcattatgttcacaatgccaatctagatgctt
3061 cctcttttgtataaagtcactgacattctttagagtgggttgggtgcatccaaaaatgta
3121 taaaaatattattataataaacttattactgcttgtagggtaattcacagttacttaccc
3181 tattcttgcttggaacatgagcctggagacccatggcagtccatatgcctccctatgcag
3241 tgaagggccctagcagtgttaacaaattgctgagatcccacggagtctttcaaaaatctc
3301 tgtagagttagtcttctccttttctcttcctgagaagttctcctgcctgcataaccattc
3361 attagggagtactttacaagcatgaaggatattagggtaagtggctaattataaatctac
3421 tctagagacatataatcatacagattattcataaaattttcagtgctgtccttccacat
3481 ttaattgcattttgctcaaactgtagaatgccctacattccccccacccaatttgctat
3541 ttccttattaaaatagaaaattataggcaagatacaattatatgcgttcctcttcctgaa
3601 attataacatttctaaacttacccacgtaggtactactgaatccaactgccaacaataaa
3661 aagactttatttagtagaggctacctttcccaccagtgactcttttctacaactgcct
3721 tgtcagtttggtaattcacttatgattttctaatgttctcttggtgaatttattatctt
3781 gtaccctctttttttttttttttttttaaagacagagtcttgctctgtcacccaggct
3841 ggagtgcagtggcacgatctcggctcactgcaagctctgcctcccgggttcacgccattc
3901 tcctgcctcagcctcccgagtagctgggactacaggtgcccgccaccatgcccggctgat
3961 ttcttttgtatttttagtagagacggagtttcaccgtgttagccaggatggtctcgatc
4021 tcctgacctcgtgatccgcccgccttggcctccaaagtgctgggattacaggtgtgagct
4081 accgcgcccggcctattatcttgtactttctaactgagccctctattttctttatttaa
4141 taatatttctccccacttgagaatcacttgttagttcttggtaggaattcagttgggcaa
4201 tgataacttttatgggcaaaaacattctattatagtgaactaatgaaaataacagcgtat
4261 tttcaatattttcttattccttaaattccactcttttaacactatgcttaaccacttaat
4321 gtgatgaaatattcctaaaagttaaatgactattaaagcatatattgttgcatgtatata
4381 ttaagtagccgatactctaaataaaaataccactgttacagataaatggggcctttaaaa
4441 atatgaaaaacaaacttgtgaaaatgtataaaagatgcatctgttgtttcaaatggcact
4501 atcttcttttcagtactacaaaaacagaataattttgaagttttagaataaatgtaatat
4561 atttactataattctaaatgtttaaatgcttttctaaaaatgcaaaactatgatgtttag
4621 ttgctttattttacctctatgtgattattttcttaattgttattttttataatcattat
4681 ttttctgaaccattcttctggcctcagaagtaggactgaattctactattgctaggtgtg
4741 agaaagtggtggtgagaaccttagagcagtggagatttgctacctggtctgtgttttgag
4801 aagtgccccttagaaagttaaagaatgtagaaaagatactcagtcttaatcctatgcaa
4861 aaaaaaaaatcaagtaattgttttcctatgaggaaaataaccatgagctgtatcatgcta
4921 cttagcttttatgtaaatatttcttatgtctcctctattaagagtatttaaaatcatatt
4981 taaatatgaatctattcatgctaacattattttcaaaacatacatggaaatttagccca
5041 gattgtctacatataaggttttatttgaattgtaaaatatttaaaagtatgaataaaat
```

Figure 2Y-4

```
5101 atatttataggtatttatcagagatgattattttgtgctacatacaggttggctaatgag
5161 ctctagtgttaaactacctgattaatttcttataaagcagcataaccttggcttgattaa
5221 ggaattctactttcaaaaattaatctgataatagtaacaaggtatattatactttcatta
5281 caatcaaattatagaaattacttgtgtaaaagggcttcaagaatatatccaattttaaa
5341 tattttaatatatctcctatctgataacttaattcttctaaattaccacttgccattaag
5401 ctatttcataataaattctgtacagtttcccccaaaaaagagatttatttatgaaatat
5461 ttaaagtttctaatgtggtattttaaataaagtatcataaatgtaataagtaaatattta
5521 tttaggaatactgtgaacactgaactaattattcctgtgtcagtctatgaaatccctgtt
5581 ttgaaatacgtaaacagcctaaaatgtgttgaattatttgtaaatccatgacttaaaa
5641 caagatacatacatagtataacacacctcacagtgttaagatttatattgtgaaatgaga
5701 caccctaccttcaattgttcatcagtgggtaaaacaaattctgatgtacattcaggacaa
5761 atgattagccctaaatgaaactgtaataatttcagtggaaactcaatctgttttttaccatt
5821 taaacagtgaattttacatgaatgaatgggttcttcacttttttttttagtatgagaaaat
5881 tatacagtgcttaattttcagagattctttccatatgttactaaaaatgttttgttcag
5941 cctaacatactgagttttttttaactttctaaattattgaatttccatcatgcattcatc
6001 caaaattaaggcagactgtttggattcttccagtggccagatgagctaaattaaatcaca
6061 aaagcagatgcttttgtatgatctccaaattgccaactttaaggaaatattctcttgaaa
6121 ttgtctttaaagatcttttgcagctttgcagatacccagactgagctggaactggaattt
6181 gtcttcctattgactctacttctttaaaagcggctgcccattacattcctcagctgtcct
6241 tgcagttaggtgtacatgtgactgagtgttggccagtgagatgaagtctcctcaaaggaa
6301 ggcagcatgtgtccttttcatcccttcatcttgctgctgggattgtggatataacagga
6361 gccctggcagctgtctccagaggatcaaagccacacccaaagagtaaggcagattagaga
6421 ccagaaagaccttgactacttccctacttccactgcttttcctgcatttaagccattgt
6481 aaatctgggtgtgttacatgaagtgaaaattaattctttctgcccttcagttctttatcc
6541 tgataccatttaacactgtctgaattaactagactgcaataattctttcttttgaaagct
6601 tttaaaggataatgtgcaattcacattaaaattgattttccattgtcaattagttatact
6661 cattttcctgccttgatctttcattagatattttgtatctgcttggaatatattatcttc
6721 tttttaactgtgtaattggtaattactaaaactctgtaatctccaaaatattgctatcaa
6781 attacacaccatgttttctatcattctcatagatctgccttataaacatttaataaaa
6841 gtactatttaatgattt
```

Figure 2Z-1

The cDNA (SEQ ID. NO. : 52) and amino acid sequence (SEQ ID. NO. : 53) of 98P4B6 v.26. The start methionine is underlined. The open reading frame extends from nucleic acid 394-1866 including the stop codon.

```
   1 gccccctccgagctccccgactcctccccgcgctccacggctcttcccgactccagtcag
  61 cgttcctcgggccctcggcgccacaagctgtccgggcacgcagccctagcggcgcgtcg
 121 ctgccaagccggcctccgcgcgcctccctccttccttctccctggctgttcgcgatcca
 181 gcttgggtaggcggggaagcagctggagtgcgaccgccacggcagccaccctgcaaccgc
 241 cagtcggaggtgcagtccgtaggccctggccccgggtgggcccttggggagtcggcgcc
 301 gctcccgaggagctgcaaggctcgccctgccggcgtggagggcgcggggggcgcggag
   1                                            M  E  S  I  M  M  G  S
 361 gatattcttggtgatcttggaagtgtccgtatcATGGAATCAATCTCTATGATGGGAAGC
  10 P  K  S  L  S  E  T  C  L  P  N  G  I  N  G  I  K  D  A  R
 421 CCTAAGAGCCTTAGTGAAACTTGTTTACCTAATGGCATAAATGGTATCAAAGATGCAAGG
  30 K  V  T  V  G  V  I  G  S  G  D  F  A  K  S  L  T  I  R  L
 481 AAGGTCACTGTAGGTGTGATTGGAAGTGGAGATTTTGCCAAATCCTTGACCATTCGACTT
  50 I  R  C  G  Y  H  V  V  I  G  S  R  N  P  K  F  A  S  E  F
 541 ATTAGATGCGGCTATCATGTGGTCATAGGAAGTAGAAATCCTAAGTTTGCTTCTGAATTT
  70 F  P  H  V  V  D  V  T  H  H  E  D  A  L  T  K  T  N  I  I
 601 TTTCCTCATGTGGTAGATGTCACTCATCATGAAGATGCTCTCACAAAAACAAATATAATA
  90 F  V  A  I  H  R  E  H  Y  T  S  L  W  D  L  R  H  L  L  V
 661 TTTGTTGCTATACACAGAGAACATTATACCTCCCTGTGGGACCTGAGACATCTGCTTGTG
 110 G  K  I  L  I  D  V  S  N  N  M  R  I  N  Q  Y  P  E  S  N
 721 GGTAAAATCCTGATTGATGTGAGCAATAACATGAGGATAAACCAGTACCCAGAATCCAAT
 130 A  E  Y  L  A  S  L  F  P  D  S  L  I  V  K  G  F  N  V  V
 781 GCTGAATATTTGGCTTCATTATTCCCAGATTCTTTGATTGTCAAAGGATTTAATGTTGTC
 150 S  A  W  A  L  Q  L  G  P  K  D  A  S  R  Q  V  Y  I  C  S
 841 TCAGCTTGGGCACTTCAGTTAGGACCTAAGGATGCCAGCCGGCAGGTTTATATATGCAGC
 170 N  N  I  Q  A  R  Q  Q  V  I  E  L  A  R  Q  L  N  F  I  P
 901 AACAATATTCAAGCGCGACAACAGGTTATTGAACTTGCCCGCCAGTTGAATTTCATTCCC
 190 I  D  L  G  S  L  S  S  A  R  E  I  E  N  L  P  L  R  L  F
 961 ATTGACTTGGGATCCTTATCATCAGCCAGAGAGATTGAAAATTTACCCCTACGACTCTTT
 210 T  L  W  R  G  P  V  V  V  A  I  S  L  A  T  F  F  L  Y
1021 ACTCTCTGGAGAGGGCCAGTGGTGGTAGCTATAAGCTTGGCCACATTTTTTTTCCTTTAT
 230 S  F  V  R  D  V  I  H  P  Y  A  R  N  Q  Q  S  D  F  Y  K
1081 TCCTTTGTCAGAGATGTGATTCATCCATATGCTAGAAACCAACAGAGTGACTTTTACAAA
 250 I  P  I  E  I  V  N  K  T  L  P  I  V  A  I  T  L  L  S  L
1141 ATTCCTATAGAGATTGTGAATAAAACCTTACCTATAGTTGCCATTACTTTGCTCTCCCTA
 270 V  Y  L  A  G  L  L  A  A  Y  Q  L  Y  Y  G  T  K  Y  R
```

Figure 2Z-2

```
1201 GTATACCTTGCAGGTCTTCTGGCAGCTGCTTATCAACTTTATTACGGCACCAAGTATAGG
 290  R  F  P  P  W  L  E  T  W  L  Q  C  R  K  Q  L  G  L  L  S
1261 AGATTTCCACCTTGGTTGGAAACCTGGTTACAGTGTAGAAAACAGCTTGGATTACTAAGT
 310  F  F  F  A  M  V  H  V  A  Y  S  L  C  L  P  M  R  R  S  E
1321 TTTTTCTTCGCTATGGTCCATGTTGCCTACAGCCTCTGCTTACCGATGAGAAGGTCAGAG
 330  R  Y  L  F  L  N  M  A  Y  Q  Q  V  H  A  N  I  E  N  S  W
1381 AGATATTTGTTTCTCAACATGGCTTATCAGCAGGTTCATGCAAATATTGAAAACTCTTGG
 350  N  E  E  E  V  W  R  I  E  M  Y  I  S  F  G  I  M  S  L  G
1441 AATGAGGAAGAAGTTTGGAGAATTGAAATGTATATCTCCTTTGGCATAATGAGCCTTGGC
 370  L  L  S  L  L  A  V  T  S  I  P  S  V  S  N  A  L  N  W  R
1501 TTACTTTCCCTCCTGGCAGTCACTTCTATCCCTTCAGTGAGCAATGCTTTAAACTGGAGA
 390  E  F  S  F  I  Q  S  T  L  G  Y  V  A  L  L  I  S  T  F  H
1561 GAATTCAGTTTTATTCAGTCTACACTTGGATATGTCGCTCTGCTCATAAGTACTTTCCAT
 410  V  L  I  Y  G  W  K  R  A  F  E  E  E  Y  Y  R  F  Y  T  P
1621 GTTTTAATTTATGGATGGAAACGAGCTTTTGAGGAAGAGTACTACAGATTTTATACACCA
 430  P  N  F  V  L  A  L  V  L  P  S  I  V  I  L  G  K  I  I  L
1681 CCAAACTTTGTTCTTGCTCTTGTTTTGCCCTCAATTGTAATTCTGGGTAAGATTATTTTA
 450  F  L  P  C  I  S  R  K  L  K  R  I  K  K  G  W  E  K  S  Q
1741 TTCCTTCCATGTATAAGCCGAAAGCTAAAACGAATTAAAAAAGGCTGGGAAAAGAGCCAA
 470  F  L  E  E  G  I  G  G  T  I  P  H  V  S  P  E  R  V  T  V
1801 TTTCTGGAAGAAGGTATTGGAGGAACAATTCCTCATGTCTCCCCGGAGAGGGTCACAGTA
 490  M  *
1861 ATGTGAtgacaaatggtgttcacagctgccatataaagttctactcatgccattattttt
1921 atgacttctacgttcagttacaagtatgctgtcaaattatcgtgggttgaaacttgttaa
1981 atgagatttcaactgacttagtgatagagttttcttcaagttaattttcacaaatgtcat
2041 gtttgccaatatgaattttctagtcaacatattattgtaatttaggtatgttttgtttt
2101 gttttgcacaactgtaaccctgttgttactttatatttcataatcaggcaaaaatactta
2161 cagttaataatatagatataatgttaaaaacaatttgcaaaccagcagaattttaagctt
2221 ttaaaataattcaatggatatacattttttttctgaagattaagattttaattattcaact
2281 taaaaagtagaaatgcattattatacattttttaagaaaggacacgttatgttagcatc
2341 taggtaaggctgcatgatagcattcctatatttctctcataaaataggatttgaaggatg
2401 aaattaattgtatgaagcaatgtgattatatgaagagacacaaattaaaaagacaaatta
2461 aacctgaaattatatttaaaatatatttgagacatgaaatacatactgataatacatacc
2521 tcatgaaagattttattctttattgtgttacagagcagtttcattttcatattaatatac
2581 tgatcaggaagaggattcagtaacatttggcttccaaaactgctatctctaatacggtac
2641 caatcctaggaactgtatactagttcctacttagaacaaaagtatcaagtttgcacacaa
2701 gtaatctgccagctgacctttgtcgcaccttaaccagtcaccacttgctatggtatagga
2761 ttatactgatgttctttgagggattctgatgtgctaggcatggttctaagtactttactt
```

Figure 2Z-3

```
2821 gtattatcccatttaatacttagaacaaccccgtgagataagtagttattatcctcattt
2881 tacacatgagggaccgaaggatagaaaagttattttttcaaaggtcttgcagttaataaat
2941 ggcagagtgagcattcaagtccaggtagtcatattccagaggccacggttttaaccacta
3001 ggctctagagctcccgccgcgcccctatgcattatgttcacaatgccaatctagatgctt
3061 cctcttttgtataaagtcactgacattctttagagtgggttgggtgcatccaaaaatgta
3121 taaaaatattattataataaacttattactgcttgtagggtaattcacagttacttaccc
3181 tattcttgcttggaacatgagcctggagacccatggcagtccatatgcctccctatgcag
3241 tgaagggccctagcagtgttaacaaattgctgagatcccacggagtctttcaaaaatctc
3301 tgtagagttagtcttctccttttctcttcctgagaagttctcctgcctgcataaccattc
3361 attagggagtactttacaagcatgaaggatattagggtaagtggctaattataaatctac
3421 tctagagacatataatcatacagattattcataaaattttttcagtgctgtccttccacat
3481 ttaattgcattttgctcaaactgtagaatgccctacattcccccaccccaatttgctat
3541 ttccttattaaaatagaaaattataggcaagatacaattatatgcgttcctcttcctgaa
3601 attataacatttctaaacttacccacgtaggtactactgaatccaactgccaacaataaa
3661 aagacttttatttagtagaggctacctttcccaccagtgactcttttctacaactgcct
3721 tgtcagtttggtaattcacttatgattttctaatgttctcttggtgaattttattatctt
3781 gtaccctctttttttttttttttttttttaaagacagagtcttgctctgtcacccaggct
3841 ggagtgcagtggcacgatctcggctcactgcaagctctgcctcccgggttcacgccattc
3901 tcctgcctcagcctcccgagtagctgggactacaggtgcccgccaccatgcccggctgat
3961 ttcttttttgtattttagtagagacggagtttcaccgtgttagccaggatggtctcgatc
4021 tcctgacctcgtgatccgcccgccttggcctccaaagtgctgggattacaggtgtgagct
4081 accgcgcccggcctattatcttgtactttctaactgagccctctatttctttatttaa
4141 taatatttctccccacttgagaatcacttgttagttcttggtaggaattcagttgggcaa
4201 tgataactttatgggcaaaaacattctattatagtgaactaatgaaaataacagcgtat
4261 tttcaatattttcttattccttaaattccactcttttaacactatgcttaaccacttaat
4321 gtgatgaaatattcctaaaagttaaatgactattaaagcatatattgttgcatgtatata
4381 ttaagtagccgatactctaaataaaaataccactgttacagataaatggggcctttaaaa
4441 atatgaaaaacaaacttgtgaaaatgtataaaagatgcatctgttgtttcaaatggcact
4501 atcttcttttcagtactacaaaaacagaataattttgaagttttagaataaatgtaatat
4561 atttactataattctaaatgtttaaatgcttttctaaaaatgcaaaactatgatgtttag
4621 ttgctttattttacctctatgtgattattttttcttaattgttattttttataatcattat
4681 ttttctgaaccattcttctggcctcagaagtaggactgaattctactattgctaggtgtg
4741 agaaagtggtggtgagaaccttagagcagtggagatttgctacctggtctgtgttttgag
4801 aagtgccccttagaaagttaaaagaatgtagaaaagatactcagtcttaatcctatgcaa
4861 aaaaaaaatcaagtaattgttttcctatgaggaaaataaccatgagctgtatcatgcta
4921 cttagcttttatgtaaatatttcttatgtctcctctattaagagtatttaaaatcatatt
4981 taaatatgaatctattcatgctaacattattttttcaaaacatacatggaaatttagccca
5041 gattgtctacatataaggttttttatttgaattgtaaaatatttaaaagtatgaataaaat
```

Figure 2Z-4

```
5101 atatttataggtatttatcagagatgattattttgtgctacatacaggttggctaatgag
5161 ctctagtgttaaactacctgattaatttcttataaagcagcataaccttggcttgattaa
5221 ggaattctactttcaaaaattaatctgataatagtaacaaggtatattatactttcatta
5281 caatcaaattatagaaattacttgtgtaaaagggcttcaagaatatatccaattttaaa
5341 tattttaatatatctcctatctgataacttaattcttctaaattaccacttgccattaag
5401 ctatttcataataaattctgtacagtttcccccaaaaaagagatttatttatgaaatat
5461 ttaaagtttctaatgtggtattttaaataaagtatcataaatgtaataagtaaatattta
5521 tttaggaatactgtgaacactgaactaattattcctgtgtcagtctatgaaatccctgtt
5581 ttgaaatacgtaaacagcctaaaatgtgttgaattattttgtaaatccatgacttaaaa
5641 caagatacatacatagtataacacacctcacagtgttaagatttatattgtgaaatgaga
5701 caccctaccttcaattgttcatcagtgggtaaaacaaattctgatgtacattcaggacaa
5761 atgattagccctaaatgaaactgtaataatttcagtggaaactcaatctgttttaccatt
5821 taaacagtgaattttacatgaatgaatgggttcttcacttttttttagtatgagaaaat
5881 tatacagtgcttaattttcagagattctttccatatgttactaaaaaatgttttgttcag
5941 cctaacatactgagttttttttaactttctaaattattgaatttccatcatgcattcatc
6001 caaaattaaggcagactgtttggattcttccagtggccagatgagctaaattaaatcaca
6061 aaagcagatgcttttgtatgatctccaaattgccaactttaaggaaatattctcttgaaa
6121 ttgtctttaaagatcttttgcagctttgcagatacccagactgagctggaactggaattt
6181 gtcttcctattgactctacttctttaaaagcggctgcccattacattcctcagctgtcct
6241 tgcagttaggtgtacatgtgactgagtgttggccagtgagatgaagtctcctcaaaggaa
6301 ggcagcatgtgtcctttttcatcccttcatcttgctgctgggattgtggatataacagga
6361 gccctggcagctgtctccagaggatcaaagccacacccaaagagtaaggcagattagaga
6421 ccagaaagaccttgactacttccctacttccactgcttttcctgcatttaagccattgt
6481 aaatctgggtgtgttacatgaagtgaaaattaattcttctgcccttcagttctttatcc
6541 tgataccatttaacactgtctgaattaactagactgcaataattctttcttttgaaagct
6601 tttaaaggataatgtgcaattcacattaaaattgattttccattgtcaattagttatact
6661 cattttcctgccttgatctttcattagatattttgtatctgcttggaatatattatcttc
6721 tttttaactgtgtaattggtaattactaaaactctgtaatctccaaaatattgctatcaa
6781 attacacaccatgttttctatcattctcatagatctgccttataaacatttaaataaaaa
6841 gtactatttaatgattt
```

Figure 2AA-1

The cDNA (SEQ ID. NO. : 54) and amino acid sequence (SEQ ID. NO. : 55) of 98P4B6 v.27. The start methionine is underlined. The open reading frame extends from nucleic acid 394-1866 including the stop codon.

```
   1 gccccctccgagctccccgactcctccccgcgctccacggctcttcccgactccagtcag
  61 cgttcctcgggccctcggcgccacaagctgtccgggcacgcagcccctagcggcgcgtcg
 121 ctgccaagccggcctccgcgcgcctccctccttccttctcccctggctgttcgcgatcca
 181 gcttgggtaggcggggaagcagctggagtgcgaccgccacggcagccacctgcaaccgc
 241 cagtcggaggtgcagtccgtaggccctggcccccgggtgggcccttggggagtcggcgcc
 301 gctcccgaggagctgcaaggctcgcccctgcccggcgtggagggcgcggggggcgcggag
   1                                             M   E   S   I   S   M   M   G   S
 361 gatattcttggtgatcttggaagtgtccgtatcATGGAATCAATCTCTATGATGGGAAGC
  10 P   K   S   L   S   E   T   C   L   P   N   G   I   N   G   I   K   D   A   R
 421 CCTAAGAGCCTTAGTGAAACTTGTTTACCTAATGGCATAAATGGTATCAAAGATGCAAGG
  30 K   V   T   V   G   V   I   G   S   G   D   F   A   K   S   L   T   I   R   L
 481 AAGGTCACTGTAGGTGTGATTGGAAGTGGAGATTTTGCCAAATCCTTGACCATTCGACTT
  50 I   R   C   G   Y   H   V   V   I   G   S   R   N   P   K   F   A   S   E   F
 541 ATTAGATGCGGCTATCATGTGGTCATAGGAAGTAGAAATCCTAAGTTTGCTTCTGAATTT
  70 F   P   H   V   V   D   V   T   H   H   E   D   A   L   T   K   T   N   I   I
 601 TTTCCTCATGTGGTAGATGTCACTCATCATGAAGATGCTCTCACAAAAACAAATATAATA
  90 F   V   A   I   H   R   E   H   Y   T   S   L   W   D   L   R   H   L   L   V
 661 TTTGTTGCTATACACAGAGAACATTATACCTCCCTGTGGGACCTGAGACATCTGCTTGTG
 110 G   K   I   L   I   D   V   S   N   N   M   R   I   N   Q   Y   P   E   S   N
 721 GGTAAAATCCTGATTGATGTGAGCAATAACATGAGGATAAACCAGTACCCAGAATCCAAT
 130 A   E   Y   L   A   S   L   F   P   D   S   L   I   V   K   G   F   N   V   V
 781 GCTGAATATTTGGCTTCATTATTCCCAGATTCTTTGATTGTCAAAGGATTTAATGTTGTC
 150 S   A   W   A   L   Q   L   G   P   K   D   A   S   R   Q   V   Y   I   C   S
 841 TCAGCTTGGGCACTTCAGTTAGGACCTAAGGATGCCAGCCGGCAGGTTTATATATGCAGC
 170 N   N   I   Q   A   R   Q   Q   V   I   E   L   A   R   Q   L   N   F   I   P
 901 AACAATATTCAAGCGCGACAACAGGTTATTGAACTTGCCCGCCAGTTGAATTTCATTCCC
 190 I   D   L   G   S   L   S   S   A   R   E   I   E   N   L   P   L   R   L   F
 961 ATTGACTTGGGATCCTTATCATCAGCCAGAGAGATTGAAAATTTACCCCTACGACTCTTT
 210 T   L   W   R   G   P   V   V   V   A   I   S   L   A   T   F   F   F   L   Y
1021 ACTCTCTGGAGAGGGCCAGTGGTGGTAGCTATAAGCTTGGCCACATTTTTTTTCCTTTAT
 230 S   F   V   R   D   V   I   H   P   Y   A   R   N   Q   Q   S   D   F   Y   K
1081 TCCTTTGTCAGAGATGTGATTCATCCATATGCTAGAAACCAACAGAGTGACTTTTACAAA
 250 I   P   I   E   I   V   N   K   T   L   P   I   V   A   I   T   L   L   S   L
1141 ATTCCTATAGAGATTGTGAATAAAACCTTACCTATAGTTGCCATTACTTTGCTCTCCCTA
 270 V   Y   L   A   G   L   L   A   A   A   Y   Q   L   Y   Y   G   T   K   Y   R
```

Figure 2AA-2

```
1201 GTATACCTTGCAGGTCTTCTGGCAGCTGCTTATCAACTTTATTACGGCACCAAGTATAGG
 290   R  F  P  P  W  L  E  T  W  L  Q  C  R  K  Q  L  G  L  L  S
1261 AGATTTCCACCTTGGTTGGAAACCTGGTTACAGTGTAGAAAACAGCTTGGATTACTAAGT
 310   F  F  F  A  M  V  H  V  A  Y  S  L  C  L  P  M  R  R  S  E
1321 TTTTTCTTCGCTATGGTCCATGTTGCCTACAGCCTCTGCTTACCGATGAGAAGGTCAGAG
 330   R  Y  L  F  L  N  M  A  Y  Q  Q  V  H  A  N  I  E  N  S  W
1381 AGATATTTGTTTCTCAACATGGCTTATCAGCAGGTTCATGCAAATATTGAAAACTCTTGG
 350   N  E  E  V  W  R  I  E  M  Y  I  S  F  G  I  M  S  L  G
1441 AATGAGGAAGAAGTTTGGAGAATTGAAATGTATATCTCCTTTGGCATAATGAGCCTTGGC
 370   L  L  S  L  L  A  V  T  S  I  P  S  V  S  N  A  L  N  W  R
1501 TTACTTTCCCTCCTGGCAGTCACTTCTATCCCTTCAGTGAGCAATGCTTTAAACTGGAGA
 390   E  F  S  F  I  Q  S  T  L  G  Y  V  A  L  L  I  S  T  F  H
1561 GAATTCAGTTTTATTCAGTCTACACTTGGATATGTCGCTCTGCTCATAAGTACTTTCCAT
 410   V  L  I  Y  G  W  K  R  A  F  E  E  E  Y  Y  R  F  Y  T  P
1621 GTTTTAATTTATGGATGGAAACGAGCTTTTGAGGAAGAGTACTACAGATTTTATACACCA
 430   P  N  F  V  L  A  L  V  L  P  S  I  V  I  L  G  K  I  I  L
1681 CCAAACTTTGTTCTTGCTCTTGTTTTGCCCTCAATTGTAATTCTGGGTAAGATTATTTTA
 450   F  L  P  C  I  S  R  K  L  K  R  I  K  K  G  W  E  K  S  Q
1741 TTCCTTCCATGTATAAGCCGAAAGCTAAAACGAATTAAAAAAGGCTGGGAAAAGAGCCAA
 470   F  L  E  E  G  M  G  G  T  I  P  H  V  S  P  E  R  V  T  V
1801 TTTCTGGAAGAAGGTATGGGAGGAACAATTCCTCATGTCTCCCCGGAGAGGGTCACAGTA
 490   M  *
1861 ATGTGAtgataaatggtgttcacagctgccatataaagttctactcatgccattattttt
1921 atgacttctacgttcagttacaagtatgctgtcaaattatcgtgggttgaaacttgttaa
1981 atgagatttcaactgacttagtgatagagttttcttcaagttaattttcacaaatgtcat
2041 gtttgccaatatgaattttcctagtcaacatattattgtaatttaggtatgttttgtttt
2101 gttttgcacaactgtaaccctgttgttactttatatttcataatcaggcaaaaatactta
2161 cagttaataatatagatataatgttaaaaacaatttgcaaaccagcagaattttaagctt
2221 ttaaaataattcaatggatatacattttttttctgaagattaagattttaattattcaact
2281 taaaaagtagaaatgcattattatacattttttttaagaaaggacacgttatgttagcatc
2341 taggtaaggctgcatgatagcattcctatatttctctcataaaataggatttgaaggatg
2401 aaattaattgtatgaagcaatgtgattatatgaagagacacaaattaaaaagacaaatta
2461 aacctgaaattatatttaaaatatatttgagacatgaaatacatactgataatacatacc
2521 tcatgaaagattttattctttattgtgttacagagcagtttcattttcatattaatatac
2581 tgatcaggaagaggattcagtaacatttggcttccaaaactgctatctctaatacggtac
2641 caatcctaggaactgtatactagttcctacttagaacaaaagtatcaagtttgcacacaa
2701 gtaatctgccagctgacctttgtcgcaccttaaccagtcaccacttgctatggtatagga
2761 ttatactgatgttctttgagggattctgatgtgctaggcatggttctaagtactttactt
```

Figure 2AA-3

```
2821  gtattatcccatttaatacttagaacaaccccgtgagataagtagttattatcctcattt
2881  tacacatgagggaccgaaggatagaaaagttattttttcaaaggtcttgcagttaataaat
2941  ggcagagtgagcattcaagtccaggtagtcatattccagaggccacggttttaaccacta
3001  ggctctagagctcccgccgcgcccctatgcattatgttcacaatgccaatctagatgctt
3061  cctcttttgtataaagtcactgacattctttagagtgggttgggtgcatccaaaaatgta
3121  taaaaatattattataataaacttattactgcttgtagggtaattcacagttacttaccc
3181  tattcttgcttggaacatgagcctggagacccatggcagtccatatgcctccctatgcag
3241  tgaagggccctagcagtgttaacaaattgctgagatcccacggagtctttcaaaaatctc
3301  tgtagagttagtcttctccttttctcttcctgagaagttctcctgcctgcataaccattc
3361  attagggagtactttacaagcatgaaggatattagggtaagtggctaattataaatctac
3421  tctagagacatataatcatacagattattcataaaattttttcagtgctgtccttccacat
3481  ttaattgcattttgctcaaactgtagaatgccctacattccccccaccccaatttgctat
3541  ttccttattaaaatagaaaattataggcaagatacaattatatgcgttcctcttcctgaa
3601  attataacatttctaaacttacccacgtaggtactactgaatccaactgccaacaataaa
3661  aagactttatttagtagaggctacctttcccaccagtgactcttttctacaactgcct
3721  tgtcagtttggtaattcacttatgattttctaatgttctcttggtgaatttattatctt
3781  gtaccctcttttttttttttttttttttaaagacagagtcttgctctgtcacccaggct
3841  ggagtgcagtggcacgatctcggctcactgcaagctctgcctcccgggttcacgccattc
3901  tcctgcctcagcctcccgagtagctgggactacaggtgcccgccaccatgcccggctgat
3961  ttctttttgtatttttagtagagacggagtttcaccgtgttagccaggatggtctcgatc
4021  tcctgacctcgtgatccgcccgccttggcctccaaagtgctgggattacaggtgtgagct
4081  accgcgcccggcctattatcttgtactttctaactgagccctctatttttctttattttaa
4141  taatatttctccccacttgagaatcacttgttagttcttggtaggaattcagttgggcaa
4201  tgataacttttatgggcaaaaacattctattatagtgaactaatgaaaataacagcgtat
4261  tttcaatattttcttattccttaaattccactcttttaacactatgcttaaccacttaat
4321  gtgatgaaatattcctaaaagttaaatgactattaaagcatatattgttgcatgtatata
4381  ttaagtagccgatactctaaataaaaataccactgttacagataaatggggcctttaaaa
4441  atatgaaaaacaaacttgtgaaaatgtataaaagatgcatctgttgtttcaaatggcact
4501  atcttcttttcagtactacaaaaacagaataattttgaagttttagaataaatgtaatat
4561  atttactataattctaaatgtttaaatgcttttctaaaaatgcaaaactatgatgtttag
4621  ttgctttattttacctctatgtgattattttttcttaattgttattttttataatcattat
4681  ttttctgaaccattcttctggcctcagaagtaggactgaattctactattgctaggtgtg
4741  agaaagtggtggtgagaaccttagagcagtggagatttgctacctggtctgtgttttgag
4801  aagtgccccttagaaagttaaaagaatgtagaaaagatactcagtcttaatcctatgcaa
4861  aaaaaaaatcaagtaattgttttcctatgaggaaaataaccatgagctgtatcatgcta
4921  cttagctttatgtaaatatttcttatgtctcctctattaagagtatttaaaatcatatt
4981  taaatatgaatctattcatgctaacattattttcaaaacatacatggaaatttagccca
5041  gattgtctacatataaggttttttatttgaattgtaaaatatttaaaagtatgaataaaat
```

Figure 2AA-4

```
5101 atatttataggtatttatcagagatgattattttgtgctacatacaggttggctaatgag
5161 ctctagtgttaaactacctgattaatttcttataaagcagcataaccttggcttgattaa
5221 ggaattctactttcaaaaattaatctgataatagtaacaaggtatattatactttcatta
5281 caatcaaattatagaaattacttgtgtaaaagggcttcaagaatatatccaattttaaa
5341 tattttaatatatctcctatctgataacttaattcttctaaattaccacttgccattaag
5401 ctatttcataataaattctgtacagtttcccccaaaaaagagatttatttatgaaatat
5461 ttaaagtttctaatgtggtattttaaataaagtatcataaatgtaataagtaaatattta
5521 tttaggaatactgtgaacactgaactaattattcctgtgtcagtctatgaaatccctgtt
5581 ttgaaatacgtaaacagcctaaaatgtgttgaaattatttgtaaatccatgacttaaaa
5641 caagatacatacatagtataacacacctcacagtgttaagatttatattgtgaaatgaga
5701 caccctaccttcaattgttcatcagtgggtaaaacaaattctgatgtacattcaggacaa
5761 atgattagccctaaatgaaactgtaataatttcagtggaaactcaatctgttttttaccctt
5821 taaacagtgaattttacatgaatgaatgggttcttcactttttttttagtatgagaaaat
5881 tatacagtgcttaattttcagagattcttccatatgttactaaaaaatgttttgttcag
5941 cctaacatactgagttttttttaactttctaaattattgaatttccatcatgcattcatc
6001 caaaattaaggcagactgtttggattcttccagtggccagatgagctaaattaaatcaca
6061 aaagcagatgcttttgtatgatctccaaattgccaactttaaggaaatattctcttgaaa
6121 ttgtctttaaagatcttttgcagctttgcagatacccagactgagctggaactggaattt
6181 gtcttcctattgactctacttctttaaaagcggctgcccattacattcctcagctgtcct
6241 tgcagttaggtgtacatgtgactgagtgttggccagtgagatgaagtctcctcaaaggaa
6301 ggcagcatgtgtcctttttcatcccttcatcttgctgctgggattgtggatataacagga
6361 gccctggcagctgtctccagaggatcaaagccacacccaaagagtaaggcagattagaga
6421 ccagaaagaccttgactacttccctacttccactgcttttcctgcatttaagccattgt
6481 aaatctgggtgtgttacatgaagtgaaaattaattctttctgcccttcagttctttatcc
6541 tgataccatttaacactgtctgaattaactagactgcaataattctttcttttgaaagct
6601 tttaaaggataatgtgcaattcacattaaaattgattttccattgtcaattagttatact
6661 catttttcctgccttgatctttcattagatattttgtatctgcttggaatatattatcttc
6721 tttttaactgtgtaattggtaattactaaaactctgtaatctccaaaatattgctatcaa
6781 attacacaccatgttttctatcattctcatagatctgccttataaacatttaaataaaaa
6841 gtactatttaatgattt
```

Figure 2AB-1

The cDNA (SEQ ID. NO.: 56) and amino acid sequence (SEQ ID. NO.: 57) of 98P4B6 v.28. The start methionine is underlined. The open reading frame extends from nucleic acid 394-1866 including the stop codon.

```
   1 gccccctccgagctccccgactcctccccgcgctccacggctcttcccgactccagtcag
  61 cgttcctcgggccctcggcgccacaagctgtccgggcacgcagcccctagcggcgcgtcg
 121 ctgccaagccggcctccgcgcgcctccctccttccttctcccctggctgttcgcgatcca
 181 gcttgggtaggcggggaagcagctggagtgcgaccgccacggcagccaccctgcaaccgc
 241 cagtcggaggtgcagtccgtaggccctggccccgggtgggcccttggggagtcggcgcc
 301 gctcccgaggagctgcaaggctcgccctgcccggcgtggagggcgcggggggcgcggag
   1                                           M  E  S  I  S  M  M  G  S
 361 gatattcttggtgatcttggaagtgtccgtatcATGGAATCAATCTCTATGATGGGAAGC
  10 P  K  S  L  S  E  T  C  L  P  N  G  I  N  G  I  K  D  A  R
 421 CCTAAGAGCCTTAGTGAAACTTGTTTACCTAATGGCATAAATGGTATCAAAGATGCAAGG
  30 K  V  T  V  G  V  I  G  S  G  D  F  A  K  S  L  T  I  R  L
 481 AAGGTCACTGTAGGTGTGATTGGAAGTGGAGATTTTGCCAAATCCTTGACCATTCGACTT
  50 I  R  C  G  Y  H  V  V  I  G  S  R  N  P  K  F  A  S  E  F
 541 ATTAGATGCGGCTATCATGTGGTCATAGGAAGTAGAAATCCTAAGTTTGCTTCTGAATTT
  70 F  P  H  V  V  D  V  T  H  H  E  D  A  L  T  K  T  N  I  I
 601 TTTCCTCATGTGGTAGATGTCACTCATCATGAAGATGCTCTCACAAAAACAAATATAATA
  90 F  V  A  I  H  R  E  H  Y  T  S  L  W  D  L  R  H  L  L  V
 661 TTTGTTGCTATACACAGAGAACATTATACCTCCCTGTGGGACCTGAGACATCTGCTTGTG
 110 G  K  I  L  I  D  V  S  N  N  M  R  I  N  Q  Y  P  E  S  N
 721 GGTAAAATCCTGATTGATGTGAGCAATAACATGAGGATAAACCAGTACCCAGAATCCAAT
 130 A  E  Y  L  A  S  L  F  P  D  S  L  I  V  K  G  F  N  V  V
 781 GCTGAATATTTGGCTTCATTATTCCCAGATTCTTTGATTGTCAAAGGATTTAATGTTGTC
 150 S  A  W  A  L  Q  L  G  P  K  D  A  S  R  Q  V  Y  I  C  S
 841 TCAGCTTGGGCACTTCAGTTAGGACCTAAGGATGCCAGCCGGCAGGTTTATATATGCAGC
 170 N  N  I  Q  A  R  Q  Q  V  I  E  L  A  R  Q  L  N  F  I  P
 901 AACAATATTCAAGCGCGACAACAGGTTATTGAACTTGCCCGCCAGTTGAATTTCATTCCC
 190 I  D  L  G  S  L  S  S  A  R  E  I  E  N  L  P  L  R  L  F
 961 ATTGACTTGGGATCCTTATCATCAGCCAGAGAGATTGAAAATTTACCCCTACGACTCTTT
 210 T  L  W  R  G  P  V  V  V  A  I  S  L  A  T  F  F  F  L  Y
1021 ACTCTCTGGAGAGGGCCAGTGGTGGTAGCTATAAGCTTGGCCACATTTTTTTTCCTTTAT
 230 S  F  V  R  D  V  I  H  P  Y  A  R  N  Q  Q  S  D  F  Y  K
1081 TCCTTTGTCAGAGATGTGATTCATCCATATGCTAGAAACCAACAGAGTGACTTTTACAAA
 250 I  P  I  E  I  V  N  K  T  L  P  I  V  A  I  T  L  L  S  L
1141 ATTCCTATAGAGATTGTGAATAAAACCTTACCTATAGTTGCCATTACTTTGCTCTCCCTA
 270 V  Y  L  A  G  L  L  A  A  A  Y  Q  L  Y  Y  G  T  K  Y  R
```

Figure 2AB-2

```
1201 GTATACCTTGCAGGTCTTCTGGCAGCTGCTTATCAACTTTATTACGGCACCAAGTATAGG
 290 R   F   P   P   W   L   E   T   W   L   Q   C   R   K   Q   L   G   L   L   S
1261 AGATTTCCACCTTGGTTGGAAACCTGGTTACAGTGTAGAAAACAGCTTGGATTACTAAGT
 310 F   F   F   A   M   V   H   V   A   Y   S   L   C   L   P   M   R   R   S   E
1321 TTTTTCTTCGCTATGGTCCATGTTGCCTACAGCCTCTGCTTACCGATGAGAAGGTCAGAG
 330 R   Y   L   F   L   N   M   A   Y   Q   Q   V   H   A   N   I   E   N   S   W
1381 AGATATTTGTTTCTCAACATGGCTTATCAGCAGGTTCATGCAAATATTGAAAACTCTTGG
 350 N   E   E   V   W   R   I   E   M   Y   I   S   F   G   I   M   S   L   G
1441 AATGAGGAAGAAGTTTGGAGAATTGAAATGTATATCTCCTTTGGCATAATGAGCCTTGGC
 370 L   L   S   L   L   A   V   T   S   I   P   S   V   S   N   A   L   N   W   R
1501 TTACTTTCCCTCCTGGCAGTCACTTCTATCCCTTCAGTGAGCAATGCTTTAAACTGGAGA
 390 E   F   S   F   I   Q   S   T   L   G   Y   V   A   L   L   I   S   T   F   H
1561 GAATTCAGTTTTATTCAGTCTACACTTGGATATGTCGCTCTGCTCATAAGTACTTTCCAT
 410 V   L   I   Y   G   W   K   R   A   F   E   E   E   Y   Y   R   F   Y   T   P
1621 GTTTTAATTTATGGATGGAAACGAGCTTTTGAGGAAGAGTACTACAGATTTTATACACCA
 430 P   N   F   V   L   A   L   V   L   P   S   I   V   I   L   G   K   I   I   L
1681 CCAAACTTTGTTCTTGCTCTTGTTTTGCCCTCAATTGTAATTCTGGGTAAGATTATTTTA
 450 F   L   P   C   I   S   R   K   L   K   R   I   K   K   G   W   E   K   S   Q
1741 TTCCTTCCATGTATAAGCCGAAAGCTAAAACGAATTAAAAAAGGCTGGGAAAAGAGCCAA
 470 F   L   E   E   G   M   G   G   T   I   P   H   V   S   P   E   R   V   T   V
1801 TTTCTGGAAGAAGGTATGGGAGGAACAATTCCTCATGTCTCCCCGGAGAGGGTCACAGTA
 490 M   *
1861 ATGTGAtgacaaatggtgttcacagctgccatataaagttctactcatgccattattttt
1921 atgacttctacgttcagttacaagtatgctgtcaaattatcgtgggttgaaacttgttaa
1981 atgagatttcaactgacttagtgatagagttttcttcaagttaattttcacaaatgtcat
2041 gtttgccaatatgaattttctagtcaacatattattgtaatttaggtatgttttgtttt
2101 gttttgcacaactgtaaccctgttgttactttatatttcataatcaggcaaaaatactta
2161 cagttaataatatagatataatgttaaaaacaatttgcaaaccagcagaattttaagctt
2221 ttaaaataattcaatggatatacatttttttctgaagattaagattttaattattcaact
2281 taaaaagtagaaatgcattattatacatttttttaagaaaggacacgttatgttagcatc
2341 taggtaaggctgcatgatagcattcctatatttctctcataaaataggatttgaaggatg
2401 aaattaattgtatgaagcaatgtgattatatgaagagacacaaattaaaaagacaaatta
2461 aacctgaaattatatttaaaatatatttgagacatgaaatacatactgataatacatacc
2521 tcatgaaagatttttattctttattgtgttacagagcagtttcattttcatattaatatac
2581 tgatcaggaagaggattcagtaacatttggcctccaaaactgctatctctaatacggtac
2641 caatcctaggaactgtatactagttcctacttagaacaaaagtatcaagtttgcacacaa
2701 gtaatctgccagctgacctttgtcgcaccttaaccagtcaccacttgctatggtatagga
2761 ttatactgatgttctttgagggattctgatgtgctaggcatggttctaagtactttactt
```

Figure 2AB-3

```
2821 gtattatcccatttaatacttagaacaaccccgtgagataagtagttattatcctcattt
2881 tacacatgagggaccgaaggatagaaaagttattttttcaaaggtcttgcagttaataaat
2941 ggcagagtgagcattcaagtccaggtagtcatattccagaggccacggttttaaccacta
3001 ggctctagagctcccgccgcgcccctatgcattatgttcacaatgccaatctagatgctt
3061 cctcttttgtataaagtcactgacattctttagagtgggttgggtgcatccaaaaatgta
3121 taaaaatattattataataaacttattactgcttgtagggtaattcacagttacttaccc
3181 tattcttgcttggaacatgagcctggagacccatggcagtccatatgcctccctatgcag
3241 tgaagggccctagcagtgttaacaaattgctgagatcccacggagtctttcaaaaatctc
3301 tgtagagttagtcttctccttttctcttcctgagaagttctcctgcctgcataaccattc
3361 attagggagtactttacaagcatgaaggatattagggtaagtggctaattataaatctac
3421 tctagagacatataatcatacagattattcataaaatttttcagtgctgtccttccacat
3481 ttaattgcattttgctcaaactgtagaatgccctacattcccccccaccccaatttgctat
3541 ttccttattaaaatagaaaattataggcaagatacaattatatgcgttcctcttcctgaa
3601 attataacatttctaaacttacccacgtaggtactactgaatccaactgccaacaataaa
3661 aagactttatttagtagaggctacctttcccaccagtgactcttttctacaactgcct
3721 tgtcagtttggtaattcacttatgattttctaatgttctcttggtgaattttattatctt
3781 gtaccctctttttttttttttttttttaaagacagagtcttgctctgtcacccaggct
3841 ggagtgcagtggcacgatctcggctcactgcaagctctgcctcccgggttcacgccattc
3901 tcctgcctcagcctcccgagtagctgggactacaggtgccgccaccatgcccggctgat
3961 ttcttttgtatttttagtagagacggagtttcaccgtgttagccaggatggtctcgatc
4021 tcctgacctcgtgatccgcccgccttggcctccaaagtgctgggattacaggtgtgagct
4081 accgcgcccggcctattatcttgtactttctaactgagccctctatttttcttatttaa
4141 taatatttctccccacttgagaatcacttgttagttcttggtaggaattcagttgggcaa
4201 tgataactttatgggcaaaaacattctattatagtgaactaatgaaaataacagcgtat
4261 tttcaatattttcttattccttaaattccactcttttaacactatgcttaaccacttaat
4321 gtgatgaaatattcctaaaagttaaatgactattaaagcatatattgttgcatgtatata
4381 ttaagtagccgatactctaaataaaaataccactgttacagataaatggggcctttaaaa
4441 atatgaaaaacaaacttgtgaaaatgtataaaagatgcatctgttgtttcaaatggcact
4501 atcttcttttcagtactacaaaaacagaataattttgaagttttagaataaatgtaatat
4561 atttactataattctaaatgtttaaatgcttttctaaaaatgcaaaactatgatgtttag
4621 ttgctttattttacctctatgtgattatttttcttaattgttatttttttataatcattat
4681 ttttctgaaccattcttctggcctcagaagtaggactgaattctactattgctaggtgtg
4741 agaaagtggtggtgagaaccttagagcagtggagatttgctacctggtctgtgttttgag
4801 aagtgccccttagaaagttaaagaatgtagaaaagatactcagtcttaatcctatgcaa
4861 aaaaaaaaatcaagtaattgttttcctatgaggaaaataaccatgagctgtatcatgcta
4921 cttagcttttatgtaaatatttcttatgtctcctctattaagagtatttaaaatcatatt
4981 taaatatgaatctattcatgctaacattattttttcaaaacatacatggaaatttagccca
5041 gattgtctacatataaggttttatttgaattgtaaaatatttaaaagtatgaataaaat
```

Figure 2AB-4

```
5101 atatttataggtatttatcagagatgattattttgtgctacatacaggttggctaatgag
5161 ctctagtgttaaactacctgattaatttcttataaagcagcataaccttggcttgattaa
5221 ggaattctactttcaaaaattaatctgataatagtaacaaggtatattatactttcatta
5281 caatcaaattatagaaattacttgtgtaaaagggcttcaagaatatatccaattttaaa
5341 tattttaatatatctcctatctgataacttaattcttctaaattaccacttgccattaag
5401 ctatttcataataaattctgtacagtttcccccaaaaaagagatttatttatgaaatat
5461 ttaaagtttctaatgtggtatttaaataaagtatcataaatgtaataagtaaatattta
5521 tttaggaatactgtgaacactgaactaattattcctgtgtcagtctatgaaatccctgtt
5581 ttgaaatacgtaaacagcctaaaatgtgttgaaattattttgtaaatccatgacttaaaa
5641 caagatacatacatagtataacacacctcacagtgttaagatttatattgtgaaatgaga
5701 caccctaccttcaattgttcatcagtgggtaaaacaaattctgatgtacattcaggacaa
5761 atgattagccctaaatgaaactgtaataatttcagtggaaactcaatctgtttttacctt
5821 taaacagtgaattttacatgaatgaatgggttcttcactttttttttagtatgagaaaat
5881 tatacagtgcttaattttcagagattctttccatatgttactaaaaaatgttttgttcag
5941 cctaacatactgagttttttttaactttctaaattattgaatttccatcatgcattcatc
6001 caaaattaaggcagactgtttggattcttccagtggccagatgagctaaattaaatcaca
6061 aaagcagatgcttttgtatgatctccaaattgccaactttaaggaaatattctcttgaaa
6121 ttgtctttaaagatcttttgcagctttgcagatacccagactgagctggaactggaattt
6181 gtcttcctattgactctacttctttaaaagcggctgcccattacattcctcagctgtcct
6241 tgcagttaggtgtacatgtgactgagtgttggccagtgagatgaagtctcctcaaaggaa
6301 ggcagcatgtgtccttttcatcccttcatcttgctgctgggattgtggatataacagga
6361 gccctggcagctgtctccagaggatcaaagccacacccaaagagtaaggcagattagaga
6421 ccagaaagaccttgactacttccctacttccactgcttttcctgcatttaagccattgt
6481 aaatctgggtgtgttacatgaagtgaaaattaattctttctgcccttcagttctttatcc
6541 tgataccatttaacactgtctgaattaactagactgcaataattctttcttttgaaagct
6601 tttaaaggataatgtgcaattcacattaaaattgattttccattgtcaattagttatact
6661 cattttcctgccttgatctttcattagatattttgtatctgcttggaatatattcttc
6721 ttttaactgtgtaattggtaattactaaaactctgtaatctccaaaatattgctatcaa
6781 attacacaccatgttttctatcattctcatagatctgccttataaacatttaaataaaaa
6841 gtactatttaatgattt
```

Figure 2AC-1

The cDNA (SEQ ID. NO. : 58) and amino acid sequence (SEQ ID. NO. : 59) of 98P4B6 v.29. The start methionine is underlined. The open reading frame extends from nucleic acid 394-1866 including the stop codon.

```
   1 gccccctccgagctccccgactcctccccgcgctccacggctcttcccgactccagtcag
  61 cgttcctcgggccctcggcgccacaagctgtccgggcacgcagcccctagcggcgcgtcg
 121 ctgccaagccggcctccgcgcgcctcctccttccttctcccctggctgttcgcgatcca
 181 gcttgggtaggcggggaagcagctggagtgcgaccgccacggcagccaccctgcaaccgc
 241 cagtcggaggtgcagtccgtaggccctggccccgggtgggcccttggggagtcggcgcc
 301 gctcccgaggagctgcaaggctcgccctgcccggcgtggagggcgcggggggcgcggag
   1                                             M   E   S   I   S   M   M   G   S
 361 gatattcttggtgatcttggaagtgtccgtatcATGGAATCAATCTCTATGATGGGAAGC
  10 P   K   S   L   S   E   T   C   L   P   N   G   I   N   G   I   K   D   A   R
 421 CCTAAGAGCCTTAGTGAAACTTGTTTACCTAATGGCATAAATGGTATCAAAGATGCAAGG
  30 K   V   T   V   G   V   I   G   S   G   D   F   A   K   S   L   T   I   R   L
 481 AAGGTCACTGTAGGTGTGATTGGAAGTGGAGATTTTGCCAAATCCTTGACCATTCGACTT
  50 I   R   C   G   Y   H   V   V   I   G   S   R   N   P   K   F   A   S   E   F
 541 ATTAGATGCGGCTATCATGTGGTCATAGGAAGTAGAAATCCTAAGTTTGCTTCTGAATTT
  70 F   P   H   V   V   D   V   T   H   H   E   D   A   L   T   K   T   N   I   I
 601 TTTCCTCATGTGGTAGATGTCACTCATCATGAAGATGCTCTCACAAAAACAAATATAATA
  90 F   V   A   I   H   R   E   H   Y   T   S   L   W   D   L   R   H   L   L   V
 661 TTTGTTGCTATACACAGAGAACATTATACCTCCCTGTGGGACCTGAGACATCTGCTTGTG
 110 G   K   I   L   I   D   V   S   N   N   M   R   I   N   Q   Y   P   E   S   N
 721 GGTAAAATCCTGATTGATGTGAGCAATAACATGAGGATAAACCAGTACCCAGAATCCAAT
 130 A   E   Y   L   A   S   L   F   P   D   S   L   I   V   K   G   F   N   V   V
 781 GCTGAATATTTGGCTTCATTATTCCCAGATTCTTTGATTGTCAAAGGATTTAATGTTGTC
 150 S   A   W   A   L   Q   L   G   P   K   D   A   S   R   Q   V   Y   I   C   S
 841 TCAGCTTGGGCACTTCAGTTAGGACCTAAGGATGCCAGCCGGCAGGTTTATATATGCAGC
 170 N   N   I   Q   A   R   Q   Q   V   I   E   L   A   R   Q   L   N   F   I   P
 901 AACAATATTCAAGCGCGACAACAGGTTATTGAACTTGCCCGCCAGTTGAATTTCATTCCC
 190 I   D   L   G   S   L   S   S   A   R   E   I   E   N   L   P   L   R   L   F
 961 ATTGACTTGGGATCCTTATCATCAGCCAGAGAGATTGAAAATTTACCCCTACGACTCTTT
 210 T   L   W   R   G   P   V   V   V   A   I   S   L   A   T   F   F   F   L   Y
1021 ACTCTCTGGAGAGGGCCAGTGGTGGTAGCTATAAGCTTGGCCACATTTTTTTTCCTTTAT
 230 S   F   V   R   D   V   I   H   P   Y   A   R   N   Q   Q   S   D   F   Y   K
1081 TCCTTTGTCAGAGATGTGATTCATCCATATGCTAGAAACCAACAGAGTGACTTTTACAAA
 250 I   P   I   E   I   V   N   K   T   L   P   I   V   A   I   T   L   L   S   L
1141 ATTCCTATAGAGATTGTGAATAAAACCTTACCTATAGTTGCCATTACTTTGCTCTCCCTA
 270 V   Y   L   A   G   L   L   A   A   A   Y   Q   L   Y   Y   G   T   K   Y   R
```

Figure 2AC-2

```
1201 GTATACCTTGCAGGTCTTCTGGCAGCTGCTTATCAACTTTATTACGGCACCAAGTATAGG
 290  R  F  P  P  W  L  E  T  W  L  Q  C  R  K  Q  L  G  L  L  S
1261 AGATTTCCACCTTGGTTGGAAACCTGGTTACAGTGTAGAAAACAGCTTGGATTACTAAGT
 310  F  F  F  A  M  V  H  V  A  Y  S  L  C  L  P  M  R  R  S  E
1321 TTTTTCTTCGCTATGGTCCATGTTGCCTACAGCCTCTGCTTACCGATGAGAAGGTCAGAG
 330  R  Y  L  F  L  N  M  A  Y  Q  Q  V  H  A  N  I  E  N  S  W
1381 AGATATTTGTTTCTCAACATGGCTTATCAGCAGGTTCATGCAAATATTGAAAACTCTTGG
 350  N  E  E  V  W  R  I  E  M  Y  I  S  F  G  I  M  S  L  G
1441 AATGAGGAAGAAGTTTGGAGAATTGAAATGTATATCTCCTTTGGCATAATGAGCCTTGGC
 370  L  L  S  L  L  A  V  T  S  I  P  S  V  S  N  A  L  N  W  R
1501 TTACTTTCCCTCCTGGCAGTCACTTCTATCCCTTCAGTGAGCAATGCTTTAAACTGGAGA
 390  E  F  S  F  I  Q  S  T  L  G  Y  V  A  L  L  I  S  T  F  H
1561 GAATTCAGTTTTATTCAGTCTACACTTGGATATGTCGCTCTGCTCATAAGTACTTTCCAT
 410  V  L  I  Y  G  W  K  R  A  F  E  E  E  Y  Y  R  F  Y  T  P
1621 GTTTTAATTTATGGATGGAAACGAGCTTTTGAGGAAGAGTACTACAGATTTTATACACCA
 430  P  N  F  V  L  A  L  V  L  P  S  I  V  I  L  G  K  I  I  L
1681 CCAAACTTTGTTCTTGCTCTTGTTTTGCCCTCAATTGTAATTCTGGGTAAGATTATTTTA
 450  F  L  P  C  I  S  R  K  L  K  R  I  K  K  G  W  E  K  S  Q
1741 TTCCTTCCATGTATAAGCCGAAAGCTAAAACGAATTAAAAAAGGCTGGGAAAAGAGCCAA
 470  F  L  E  E  G  M  G  G  T  I  P  H  V  S  P  E  R  V  T  V
1801 TTTCTGGAAGAAGGTATGGGAGGAACAATTCCTCATGTCTCCCCGGAGAGGGTCACAGTA
 490  M  *
1861 ATGTGAtgacaaatggtgttcacagctgccatataaagttctactcatgccattattttt
1921 atgacttctacgttcagttacaagtatgctgtcaaattatcgtgggttgaaacttgttaa
1981 atgagatttcaactgacttagtgatagagttttcttcaagttaattttcacaaatgtcat
2041 gtttgccaatatgaattttctagtcaacatattattgtaatttaggtatgttttgtttt
2101 gttttgcacaactgtaaccctgttgttactttatatttcataatcaggcaaaaatactta
2161 cagttaataatatagatataatgttaaaaacaatttgcaaaccagcagaattttaagctt
2221 ttaaaataattcaatggatatacatttttttctgaagattaagattttaattattcaact
2281 taaaaagtagaaatgcattattatacatttttttaagaaaggacacgttatgttagcatc
2341 taggtaaggctgcatgatagcattcctatatttctctcataaaataggatttgaaggatg
2401 aaattaattgtatgaagcaatgtgattatatgaagagacacaaattaaaaagacaaatta
2461 aacctgaaattatatttaaaatatatttgagacatgaaatacatactgataatacatacc
2521 tcatgaaagatttattctttattgtgttacagagcagtttcattttcatattaatatac
2581 tgatcaggaagaggattcagtaacatttggcttccaaaactgctatctctaatacggtac
2641 caatcctaggaactgtatactagttcctacttagaacaaaagtatcaagtttgcacacaa
2701 gtaatctgccagctgacctttgtcgcaccttaaccagtcaccacttgctatggtatagga
2761 ttatactgatgttctttgagggattctgatgtgctaggcatggttctaagtactttactt
```

Figure 2AC-3

```
2821 gtattatcccatttaatacttagaacaaccccgtgagataagtagttattatcctcattt
2881 tacacatgagggaccgaaggatagaaaagttattttttcaaaggtcatgcagttaataaat
2941 ggcagagtgagcattcaagtccaggtagtcatattccagaggccacggttttaaccacta
3001 ggctctagagctcccgccgcgcccctatgcattatgttcacaatgccaatctagatgctt
3061 cctcttttgtataaagtcactgacattctttagagtgggttgggtgcatccaaaaatgta
3121 taaaaatattattataataaacttattactgcttgtagggtaattcacagttacttaccc
3181 tattcttgcttggaacatgagcctggagacccatggcagtccatatgcctccctatgcag
3241 tgaagggccctagcagtgttaacaaattgctgagatcccacggagtcttttcaaaaatctc
3301 tgtagagttagtcttctccttttctcttcctgagaagttctcctgcctgcataaccattc
3361 attagggagtactttacaagcatgaaggatattagggtaagtggctaattataaatctac
3421 tctagagacatataatcatacagattattcataaaattttttcagtgctgtccttccacat
3481 ttaattgcattttgctcaaactgtagaatgccctacattccccccaccccaatttgctat
3541 ttccttattaaaatagaaaattataggcaagatacaattatatgcgttcctcttcctgaa
3601 attataacatttctaaacttacccacgtaggtactactgaatccaactgccaacaataaa
3661 aagacttttatttagtagaggctaccttttcccaccagtgactcttttttctacaactgcct
3721 tgtcagtttggtaattcacttatgattttctaatgttctcttggtgaattttattatctt
3781 gtaccctctttttttttttttttttttaaagacagagtcttgctctgtcacccaggct
3841 ggagtgcagtggcacgatctcggctcactgcaagctctgcctcccgggttcacgccattc
3901 tcctgcctcagcctcccgagtagctgggactacaggtgcccgccaccatgcccggctgat
3961 ttcttttgtatttttagtagagacggagtttcaccgtgttagccaggatggtctcgatc
4021 tcctgacctcgtgatccgccgccttggcctccaaagtgctgggattacaggtgtgagct
4081 accgcgcccggcctattatcttgtactttctaactgagccctctattttctttatttaa
4141 taatatttctccccacttgagaatcacttgttagttcttggtaggaattcagttgggcaa
4201 tgataacttttatgggcaaaaacattctattatagtgaactaatgaaaataacagcgtat
4261 tttcaatattttcttattccttaaattccactcttttaacactatgcttaaccacttaat
4321 gtgatgaaatattcctaaaagttaaatgactattaaagcatatattgttgcatgtatata
4381 ttaagtagccgatactctaaataaaataccactgttacagataaatggggccttttaaaa
4441 atatgaaaaacaaacttgtgaaaatgtataaaagatgcatctgttgtttcaaatggcact
4501 atcttcttttcagtactacaaaaacagaataattttgaagtttagaataaatgtaatat
4561 atttactataattctaaatgtttaaatgcttttctaaaaatgcaaaactatgatgtttag
4621 ttgctttatttttacctctatgtgattattttttcttaattgttattttttataatcattat
4681 ttttctgaaccattcttctggcctcagaagtaggactgaattctactattgctaggtgtg
4741 agaaagtggtggtgagaaccttagagcagtggagatttgctacctggtctgtgttttgag
4801 aagtgcccttagaaagtaaaagaatgtagaaaagatactcagtcttaatcctatgcaa
4861 aaaaaaaaatcaagtaattgttttcctatgaggaaaataaccatgagctgtatcatgcta
4921 cttagcttttatgtaaatatttcttatgtctcctctattaagagtatttaaaatcatatt
4981 taaatatgaatctattcatgctaacattattttttcaaaacatacatggaaatttagccca
5041 gattgtctacatataaggttttatttgaattgtaaaatatttaaagtatgaataaaat
```

Figure 2AC-4

```
5101 atatttataggtatttatcagagatgattattttgtgctacatacaggttggctaatgag
5161 ctctagtgttaaactacctgattaatttcttataaagcagcataaccttggcttgattaa
5221 ggaattctactttcaaaaattaatctgataatagtaacaaggtatattatactttcatta
5281 caatcaaattatagaaattacttgtgtaaaagggcttcaagaatatatccaattttaaa
5341 tattttaatatatctcctatctgataacttaattcttctaaattaccacttgccattaag
5401 ctatttcataataaattctgtacagtttccccccaaaaaagagatttatttatgaaatat
5461 ttaaagtttctaatgtggtatttaaataaagtatcataaatgtaataagtaaatattta
5521 tttaggaatactgtgaacactgaactaattattcctgtgtcagtctatgaaatccctgtt
5581 ttgaaatacgtaaacagcctaaaatgtgttgaaattattttgtaaatccatgacttaaaa
5641 caagatacatacatagtataacacacctcacagtgttaagatttatattgtgaaatgaga
5701 caccctaccttcaattgttcatcagtgggtaaaacaaattctgatgtacattcaggacaa
5761 atgattagccctaaatgaaactgtaataatttcagtggaaactcaatctgttttacctt
5821 taaacagtgaattttacatgaatgaatgggttcttcactttttttttagtatgagaaaat
5881 tatacagtgcttaattttcagagattcttccatatgttactaaaaatgttttgttcag
5941 cctaacatactgagtttttttaactttctaaattattgaatttccatcatgcattcatc
6001 caaaattaaggcagactgtttggattcttccagtggccagatgagctaaattaaatcaca
6061 aaagcagatgcttttgtatgatctccaaattgccaactttaaggaaatattctcttgaaa
6121 ttgtctttaaagatcttttgcagctttgcagatacccagactgagctggaactggaattt
6181 gtcttcctattgactctacttctttaaaagcggctgcccattacattcctcagctgtcct
6241 tgcagttaggtgtacatgtgactgagtgttggccagtgagatgaagtctcctcaaaggaa
6301 ggcagcatgtgtccttttcatcccttcatcttgctgctgggattgtggatataacagga
6361 gccctggcagctgtctccagaggatcaaagccacacccaaagagtaaggcagattagaga
6421 ccagaaagaccttgactacttccctacttccactgcttttcctgcatttaagccattgt
6481 aaatctgggtgtgttacatgaagtgaaattaattctttctgcccttcagttctttatcc
6541 tgataccatttaacactgtctgaattaactagactgcaataattctttcttttgaaagct
6601 tttaaaggataatgtgcaattcacattaaaattgattttccattgtcaattagttatact
6661 catttcctgccttgatctttcattagatattttgtatctgcttggaatatattatcttc
6721 tttttaactgtgtaattggtaattactaaaactctgtaatctccaaaatattgctatcaa
6781 attacacaccatgttttctatcattctcatagatctgccttataaacatttaaataaaaa
6841 gtactatttaatgattt
```

Figure 2AD-1

The cDNA (SEQ ID. NO.: 60) and amino acid sequence (SEQ ID. NO.: 61) of 98P4B6 v.30. The start methionine is underlined. The open reading frame extends from nucleic acid 394-1866 including the stop codon.

```
   1 gccccctccgagctccccgactcctccccgcgctccacggctcttcccgactccagtcag
  61 cgttcctcgggccctcggcgccacaagctgtccgggcacgcagcccctagcggcgcgtcg
 121 ctgccaagccggcctccgcgcgcctcctccttccttctccctggctgttcgcgatcca
 181 gcttgggtaggcggggaagcagctggagtgcgaccgccacggcagccacctgcaaccgc
 241 cagtcggaggtgcagtccgtaggccctggccccgggtgggcccttggggagtcggcgcc
 301 gctcccgaggagctgcaaggctcgcccctgcccggcgtggagggcgcggggggcgcggag
   1                                            M  E  S  I  S  M  M  G  S
 361 gatattcttggtgatcttggaagtgtccgtatcATGGAATCAATCTCTATGATGGGAAGC
  10 P  K  S  L  S  E  T  C  L  P  N  G  I  N  G  I  K  D  A  R
 421 CCTAAGAGCCTTAGTGAAACTTGTTTACCTAATGGCATAAATGGTATCAAAGATGCAAGG
  30 K  V  T  V  G  V  I  G  S  G  D  F  A  K  S  L  T  I  R  L
 481 AAGGTCACTGTAGGTGTGATTGGAAGTGGAGATTTTGCCAAATCCTTGACCATTCGACTT
  50 I  R  C  G  Y  H  V  V  I  G  S  R  N  P  K  F  A  S  E  F
 541 ATTAGATGCGGCTATCATGTGGTCATAGGAAGTAGAAATCCTAAGTTTGCTTCTGAATTT
  70 F  P  H  V  V  D  V  T  H  H  E  D  A  L  T  K  T  N  I  I
 601 TTTCCTCATGTGGTAGATGTCACTCATCATGAAGATGCTCTCACAAAAACAAATATAATA
  90 F  V  A  I  H  R  E  H  Y  T  S  L  W  D  L  R  H  L  L  V
 661 TTTGTTGCTATACACAGAGAACATTATACCTCCCTGTGGGACCTGAGACATCTGCTTGTG
 110 G  K  I  L  I  D  V  S  N  N  M  R  I  N  Q  Y  P  E  S  N
 721 GGTAAAATCCTGATTGATGTGAGCAATAACATGAGGATAAACCAGTACCCAGAATCCAAT
 130 A  E  Y  L  A  S  L  F  P  D  S  L  I  V  K  G  F  N  V  V
 781 GCTGAATATTTGGCTTCATTATTCCCAGATTCTTTGATTGTCAAAGGATTTAATGTTGTC
 150 S  A  W  A  L  Q  L  G  P  K  D  A  S  R  Q  V  Y  I  C  S
 841 TCAGCTTGGGCACTTCAGTTAGGACCTAAGGATGCCAGCCGGCAGGTTTATATATGCAGC
 170 N  N  I  Q  A  R  Q  Q  V  I  E  L  A  R  Q  L  N  F  I  P
 901 AACAATATTCAAGCGCGACAACAGGTTATTGAACTTGCCCGCCAGTTGAATTTCATTCCC
 190 I  D  L  G  S  L  S  S  A  R  E  I  E  N  L  P  L  R  L  F
 961 ATTGACTTGGGATCCTTATCATCAGCCAGAGAGATTGAAAATTTACCCCTACGACTCTTT
 210 T  L  W  R  G  P  V  V  A  I  S  L  A  T  F  F  F  L  Y
1021 ACTCTCTGGAGAGGGCCAGTGGTGGTAGCTATAAGCTTGGCCACATTTTTTTTCCTTTAT
 230 S  F  V  R  D  V  I  H  P  Y  A  R  N  Q  Q  S  D  F  Y  K
1081 TCCTTTGTCAGAGATGTGATTCATCCATATGCTAGAAACCAACAGAGTGACTTTTACAAA
 250 I  P  I  E  I  V  N  K  T  L  P  I  V  A  I  T  L  L  S  L
1141 ATTCCTATAGAGATTGTGAATAAAACCTTACCTATAGTTGCCATTACTTTGCTCTCCCTA
 270 V  Y  L  A  G  L  L  A  A  A  Y  Q  L  Y  Y  G  T  K  Y  R
```

Figure 2AD-2

```
1201 GTATACCTTGCAGGTCTTCTGGCAGCTGCTTATCAACTTTATTACGGCACCAAGTATAGG
 290 R   F   P   P   W   L   E   T   W   L   Q   C   R   K   Q   L   G   L   L   S
1261 AGATTTCCACCTTGGTTGGAAACCTGGTTACAGTGTAGAAAACAGCTTGGATTACTAAGT
 310 F   F   F   A   M   V   H   V   A   Y   S   L   C   L   P   M   R   R   S   E
1321 TTTTTCTTCGCTATGGTCCATGTTGCCTACAGCCTCTGCTTACCGATGAGAAGGTCAGAG
 330 R   Y   L   F   L   N   M   A   Y   Q   Q   V   H   A   N   I   E   N   S   W
1381 AGATATTTGTTTCTCAACATGGCTTATCAGCAGGTTCATGCAAATATTGAAAACTCTTGG
 350 N   E   E   V   W   R   I   E   M   Y   I   S   F   G   I   M   S   L   G
1441 AATGAGGAAGAAGTTTGGAGAATTGAAATGTATATCTCCTTTGGCATAATGAGCCTTGGC
 370 L   L   S   L   L   A   V   T   S   I   P   S   V   S   N   A   L   N   W   R
1501 TTACTTTCCCTCCTGGCAGTCACTTCTATCCCTTCAGTGAGCAATGCTTTAAACTGGAGA
 390 E   F   S   F   I   Q   S   T   L   G   Y   V   A   L   L   I   S   T   F   H
1561 GAATTCAGTTTTATTCAGTCTACACTTGGATATGTCGCTCTGCTCATAAGTACTTTCCAT
 410 V   L   I   Y   G   W   K   R   A   F   E   E   E   Y   Y   R   F   Y   T   P
1621 GTTTTAATTTATGGATGGAAACGAGCTTTTGAGGAAGAGTACTACAGATTTTATACACCA
 430 P   N   F   V   L   A   L   V   L   P   S   I   V   I   L   G   K   I   I   L
1681 CCAAACTTTGTTCTTGCTCTTGTTTTGCCCTCAATTGTAATTCTGGGTAAGATTATTTTA
 450 F   L   P   C   I   S   R   K   L   K   R   I   K   K   G   W   E   K   S   Q
1741 TTCCTTCCATGTATAAGCCGAAAGCTAAAACGAATTAAAAAAGGCTGGGAAAAGAGCCAA
 470 F   L   E   E   G   M   G   G   T   I   P   H   V   S   P   E   R   V   T   V
1801 TTTCTGGAAGAAGGTATGGGAGGAACAATTCCTCATGTCTCCCGGAGAGGGTCACAGTA
 490 M   *
1861 ATGTGAtgacaaatggtgttcacagctgccatataaagttctactcatgccattattttt
1921 atgacttctacgttcagttacaagtatgctgtcaaattatcgtgggttgaaacttgttaa
1981 atgagatttcaactgacttagtgatagagttttcttcaagttaattttcacaaatgtcat
2041 gtttgccaatatgaattttctagtcaacatattattgtaatttaggtatgttttgtttt
2101 gttttgcacaactgtaaccctgttgttactttatatttcataatcaggcaaaaatactta
2161 cagttaataatatagatataatgttaaaaacaatttgcaaaccagcagaattttaagctt
2221 ttaaaataattcaatggatatacatttttttctgaagattaagattttaattattcaact
2281 taaaaagtagaaatgcattattatacatttttttaagaaaggacacgttatgttagcatc
2341 taggtaaggctgcatgatagcattcctatatttctctcataaaataggatttgaaggatg
2401 aaattaattgtatgaagcaatgtgattatatgaagagacacaaattaaaaagacaaatta
2461 aacctgaaattatatttaaaatatatttgagacatgaaatacatactgataatacatacc
2521 tcatgaaagatttttattctttattgtgttacagagcagtttcattttcatattaatatac
2581 tgatcaggaagaggattcagtaacatttggcttccaaaactgctatctctaatacggtac
2641 caatcctaggaactgtatactagttcctacttagaacaaaagtatcaagtttgcacacaa
2701 gtaatctgccagctgacctttgtcgcaccttaaccagtcaccacttgctatggtatagga
2761 ttatactgatgttctttgagggattctgatgtgctaggcatggttctaagtactttactt
```

Figure 2AD-3

```
2821 gtattatcccatttaatacttagaacaaccccgtgagataagtagttattatcctcattt
2881 tacacatgagggaccgaaggatagaaaagttattttttcaaaggtcttgcagttaataaat
2941 ggcagagtgagcattcaagtccaggtagtcatattccagaggccacggttttaaccacta
3001 ggctctagagctcccgccgcgcccctatgcattatgttcacaatgccaatctagatgctt
3061 cctcttttgtataaagtcactgacattctttagagtgggttgggtgcatccaaaaatgta
3121 taaaaatattattataataaacttattactgcttgtagggtaattcacagttacttaccc
3181 tattcttgcttggaacatgagcctggagacccatggcagtccatatgcctccctatgcag
3241 tgaagggccctagcagtgttaacaaattgctgagatcccacggagtcttttcaaaaatctc
3301 tgtagagttagtcttctccttttctcttcctgagaagttctcctgcctgcataaccattc
3361 attagggagtactttacaagcatgaaggatattagggtaagtggctaattataaatctac
3421 tctagagacatataatcatacagattattcataaaattttttcagtgctgtccttccacat
3481 ttaattgcattttgctcaaactgtagaatgccctacattccccccacccaatttgctat
3541 ttccttattaaaatagaaaattataggcaagatacaattatatgcgttcctcttcctgaa
3601 attataacatttctaaacttacccacgtaggtactactgaatccaactgccaacaataaa
3661 aagactttttatttagtagaggctaccttttcccaccagtgactctttttctacaactgcct
3721 tgtcagtttggtaattcacttatgattttctaatgttctcttggtgaattttattatctt
3781 gtaccctctttttttttttttttttttaaagacagagtcttgctctgtcacccaggct
3841 ggagtgcagtggcacgatctcggctcactgcaagctctgcctcccgggttcacgccattc
3901 tcctgcctcagcctcccgagtagctgggactacaggtgcccgccaccatgcccggctgat
3961 ttcttttgtatttttagtagagacggagtttcaccgtgttagccaggatggtctcgatc
4021 tcctgacctcgtgatccgccgccttggcctccaaagtgctgggattacaggtgtgagct
4081 accgcgcccggcctattatcttgtactttctaactgagccctctatttttctttattttaa
4141 taatatttctccccacttgagaatcacttgttagttcttggtaggaattcagttgggcaa
4201 tgataactttatgggcaaaaacattctattatagtgaacaaatgaaaataacagcgtat
4261 tttcaatattttcttattccttaaattccactcttttaacactatgcttaaccacttaat
4321 gtgatgaaatattcctaaaagttaaatgactattaaagcatatattgttgcatgtatata
4381 ttaagtagccgatactctaaataaaaataccactgttacagataaatggggcctttaaaa
4441 atatgaaaaacaaacttgtgaaaatgtataaaagatgcatctgttgtttcaaatggcact
4501 atcttcttttcagtactacaaaaacagaataattttgaagttttagaataaatgtaatat
4561 atttactataattctaaatgtttaaatgcttttctaaaaatgcaaaactatgatgtttag
4621 ttgctttattttacctctatgtgattattttttcttaattgttattttttataatcattat
4681 ttttctgaaccattcttctggcctcagaagtaggactgaattctactattgctaggtgtg
4741 agaaagtggtggtgagaaccttagagcagtggagatttgctacctggtctgtgttttgag
4801 aagtgccccttagaaagttaaaagaatgtagaaaagatactcagtcttaatcctatgcaa
4861 aaaaaaaatcaagtaattgttttcctatgaggaaaataaccatgagctgtatcatgcta
4921 cttagcttttatgtaaatatttcttatgtctcctctattaagagtatttaaaatcatatt
4981 taaatatgaatctattcatgctaacattattttttcaaaacatacatggaaatttagccca
5041 gattgtctacatataaggttttttatttgaattgtaaaatatttaaaagtatgaataaaat
```

Figure 2AD-4

```
5101 atatttataggtatttatcagagatgattatttttgtgctacatacaggttggctaatgag
5161 ctctagtgttaaactacctgattaatttcttataaagcagcataaccttggcttgattaa
5221 ggaattctactttcaaaaattaatctgataatagtaacaaggtatattatactttcatta
5281 caatcaaattatagaaattacttgtgtaaaagggcttcaagaatatatccaatttttaaa
5341 tattttaatatatctcctatctgataacttaattcttctaaattaccacttgccattaag
5401 ctatttcataataaattctgtacagtttccccccaaaaaagagatttatttatgaaatat
5461 ttaaagtttctaatgtggtattttaaataaagtatcataaatgtaataagtaaatattta
5521 tttaggaatactgtgaacactgaactaattattcctgtgtcagtctatgaaatccctgtt
5581 ttgaaatacgtaaacagcctaaatgtgttgaaattattttgtaaatccatgacttaaaa
5641 caagatacatacatagtataacacacctcacagtgttaagatttatattgtgaaatgaga
5701 caccctaccttcaattgttcatcagtgggtaaaacaaattctgatgtacattcaggacaa
5761 atgattagccctaaatgaaactgtaataatttcagtggaaactcaatctgttttaccttt
5821 taaacagtgaatttacatgaatgaatgggttcttcactttttttttagtatgagaaaat
5881 tatacagtgcttaattttcagagattctttccatatgttactaaaaaatgttttgttcag
5941 cctaacatactgagtttttttttaactttctaaattattgaatttccatcatgcattcatc
6001 caaaattaaggcagactgtttggattcttccagtggccagatgagctaaattaaatcaca
6061 aaagcagatgcttttgtatgatctccaaattgccaactttaaggaaatattctcttgaaa
6121 ttgtctttaaagatcttttgcagctttgcagatacccagactgagctggaactggaattt
6181 gtcttcctattgactctacttcttttaaaagcggctgcccattacattcctcagctgtcct
6241 tgcagttaggtgtacatgtgactgagtgttggccagtgagatgaagtctcctcaaaggaa
6301 ggcagcatgtgtccttttcatcccttcatcttgctgctgggattgtggatataacagga
6361 gccctggcagctgtctccagaggatcaaagccacacccaaagagtaaggcagattagaga
6421 ccagaaagaccttgactacttccctacttccactgcttttcctgcatttaagccattgt
6481 aaatctgggtgtgttacatgaagtgaaaattaattctttctgcccttcagttctttatcc
6541 tgataccatttaacactgtctgaattaactagactgcaataattctttcttttgaaagct
6601 tttaaaggataatgtgcaattcacattaaaattgattttccattgtcaattagttatact
6661 catttcctgccttgatctttcattagatattttgtatctgcttggaatatattatcttc
6721 tttttaactgtgtaattggtaattactaaaactctgtaatctccaaaatattgctatcaa
6781 attacacaccatgttttctatcattctcatagatctgccttataaacatttaaataaaaa
6841 gtactatttaatgattt
```

Figure 2AE-1

The cDNA (SEQ ID. NO. : 62) and amino acid sequence (SEQ ID. NO. : 63) of 98P4B6 v.31. The start methionine is underlined. The open reading frame extends from nucleic acid 394-1866 including the stop codon.

```
   1 gcccctccgagctccccgactcctcccgcgctccacggctcttcccgactccagtcag
  61 cgttcctcgggccctcggcgccacaagctgtccgggcacgcagcccctagcggcgcgtcg
 121 ctgccaagccggcctccgcgcgcctcctccttccttctccctggctgttcgcgatcca
 181 gcttgggtaggcggggaagcagctggagtgcgaccgccacggcagccaccctgcaaccgc
 241 cagtcggaggtgcagtccgtaggccctggccccgggtgggcccttggggagtcggcgcc
 301 gctcccgaggagctgcaaggctcgcccctgcccggcgtggagggcgcgggggcgcggag
   1                                           M  E  S  I  S  M  M  G  S
 361 gatattcttggtgatcttggaagtgtccgtatcATGGAATCAATCTCTATGATGGGAAGC
  10 P  K  S  L  S  E  T  C  L  P  N  G  I  N  G  I  K  D  A  R
 421 CCTAAGAGCCTTAGTGAAACTTGTTTACCTAATGGCATAAATGGTATCAAAGATGCAAGG
  30 K  V  T  V  G  V  I  G  S  G  D  F  A  K  S  L  T  I  R  L
 481 AAGGTCACTGTAGGTGTGATTGGAAGTGGAGATTTTGCCAAATCCTTGACCATTCGACTT
  50 I  R  C  G  Y  H  V  V  I  G  S  R  N  P  K  F  A  S  E  F
 541 ATTAGATGCGGCTATCATGTGGTCATAGGAAGTAGAAATCCTAAGTTTGCTTCTGAATTT
  70 F  P  H  V  V  D  V  T  H  H  E  D  A  L  T  K  T  N  I  I
 601 TTTCCTCATGTGGTAGATGTCACTCATCATGAAGATGCTCTCACAAAAACAAATATAATA
  90 F  V  A  I  H  R  E  H  Y  T  S  L  W  D  L  R  H  L  L  V
 661 TTTGTTGCTATACACAGAGAACATTATACCTCCCTGTGGGACCTGAGACATCTGCTTGTG
 110 G  K  I  L  I  D  V  S  N  N  M  R  I  N  Q  Y  P  E  S  N
 721 GGTAAAATCCTGATTGATGTGAGCAATAACATGAGGATAAACCAGTACCCAGAATCCAAT
 130 A  E  Y  L  A  S  L  F  P  D  S  L  I  V  K  G  F  N  V  V
 781 GCTGAATATTTGGCTTCATTATTCCCAGATTCTTTGATTGTCAAAGGATTTAATGTTGTC
 150 S  A  W  A  L  Q  L  G  P  K  D  A  S  R  Q  V  Y  I  C  S
 841 TCAGCTTGGGCACTTCAGTTAGGACCTAAGGATGCCAGCCGGCAGGTTTATATATGCAGC
 170 N  N  I  Q  A  R  Q  Q  V  I  E  L  A  R  Q  L  N  F  I  P
 901 AACAATATTCAAGCGCGACAACAGGTTATTGAACTTGCCCGCCAGTTGAATTTCATTCCC
 190 I  D  L  G  S  L  S  S  A  R  E  I  E  N  L  P  L  R  L  F
 961 ATTGACTTGGGATCCTTATCATCAGCCAGAGAGATTGAAAATTTACCCCTACGACTCTTT
 210 T  L  W  R  G  P  V  V  V  A  I  S  L  A  T  F  F  F  L  Y
1021 ACTCTCTGGAGAGGGCCAGTGGTGGTAGCTATAAGCTTGGCCACATTTTTTTTCCTTTAT
 230 S  F  V  R  D  V  I  H  P  Y  A  R  N  Q  Q  S  D  F  Y  K
1081 TCCTTTGTCAGAGATGTGATTCATCCATATGCTAGAAACCAACAGAGTGACTTTTACAAA
 250 I  P  I  E  I  V  N  K  T  L  P  I  V  A  I  T  L  L  S  L
1141 ATTCCTATAGAGATTGTGAATAAAACCTTACCTATAGTTGCCATTACTTTGCTCTCCCTA
 270 V  Y  L  A  G  L  L  A  A  A  Y  Q  L  Y  Y  G  T  K  Y  R
```

Figure 2AE-2

```
1201 GTATACCTTGCAGGTCTTCTGGCAGCTGCTTATCAACTTTATTACGGCACCAAGTATAGG
 290 R   F   P   P   W   L   E   T   W   L   Q   C   R   K   Q   L   G   L   L   S
1261 AGATTTCCACCTTGGTTGGAAACCTGGTTACAGTGTAGAAAACAGCTTGGATTACTAAGT
 310 F   F   F   A   M   V   H   V   A   Y   S   L   C   L   P   M   R   R   S   E
1321 TTTTTCTTCGCTATGGTCCATGTTGCCTACAGCCTCTGCTTACCGATGAGAAGGTCAGAG
 330 R   Y   L   F   L   N   M   A   Y   Q   Q   V   H   A   N   I   E   N   S   W
1381 AGATATTTGTTTCTCAACATGGCTTATCAGCAGGTTCATGCAAATATTGAAAACTCTTGG
 350 N   E   E   V   W   R   I   E   M   Y   I   S   F   G   I   M   S   L   G
1441 AATGAGGAAGAAGTTTGGAGAATTGAAATGTATATCTCCTTTGGCATAATGAGCCTTGGC
 370 L   L   S   L   L   A   V   T   S   I   P   S   V   S   N   A   L   N   W   R
1501 TTACTTTCCCTCCTGGCAGTCACTTCTATCCCTTCAGTGAGCAATGCTTTAAACTGGAGA
 390 E   F   S   F   I   Q   S   T   L   G   Y   V   A   L   L   I   S   T   F   H
1561 GAATTCAGTTTTATTCAGTCTACACTTGGATATGTCGCTCTGCTCATAAGTACTTTCCAT
 410 V   L   I   Y   G   W   K   R   A   F   E   E   E   Y   Y   R   F   Y   T   P
1621 GTTTTAATTTATGGATGGAAACGAGCTTTTGAGGAAGAGTACTACAGATTTTATACACCA
 430 P   N   F   V   L   A   L   V   L   P   S   I   V   I   L   G   K   I   I   L
1681 CCAAACTTTGTTCTTGCTCTTGTTTTGCCCTCAATTGTAATTCTGGGTAAGATTATTTTA
 450 F   L   P   C   I   S   R   K   L   K   R   I   K   K   G   W   E   K   S   Q
1741 TTCCTTCCATGTATAAGCCGAAAGCTAAAACGAATTAAAAAAGGCTGGGAAAAGAGCCAA
 470 F   L   E   E   G   M   G   G   T   I   P   H   V   S   P   E   R   V   T   V
1801 TTTCTGGAAGAAGGTATGGGAGGAACAATTCCTCATGTCTCCCCGGAGAGGGTCACAGTA
 490 M   *
1861 ATGTGAtgacaaatggtgttcacagctgccatataaagttctactcatgccattattttt
1921 atgacttctacgttcagttacaagtatgctgtcaaattatcgtgggttgaaacttgttaa
1981 atgagatttcaactgacttagtgatagagttttcttcaagttaattttcacaaatgtcat
2041 gtttgccaatatgaatttttctagtcaacatattattgtaatttaggtatgttttgtttt
2101 gttttgcacaactgtaaccctgttgttactttatatttcataatcaggcaaaaatactta
2161 cagttaataatatagatataatgttaaaaacaatttgcaaaccagcagaattttaagctt
2221 ttaaaataattcaatggatatacattttttctgaagattaagattttaattattcaact
2281 taaaaagtagaaatgcattattatacatttttttaagaaaggacacgttatgttagcatc
2341 taggtaaggctgcatgatagcattcctatatttctctcataaaataggatttgaaggatg
2401 aaattaattgtatgaagcaatgtgattatatgaagagacacaaattaaaaagacaaatta
2461 aacctgaaattatatttaaaatatatttgagacatgaaatacatactgataatacatacc
2521 tcatgaaagatttattctttattgtgttacagagcagtttcattttcatattaatatac
2581 tgatcaggaagaggattcagtaacatttggcttccaaaactgctatctctaatacggtac
2641 caatcctaggaactgtatactagttcctacttagaacaaaagtatcaagtttgcacacaa
2701 gtaatctgccagctgacctttgtcgcaccttaaccagtcaccacttgctatggtatagga
2761 ttatactgatgttctttgagggattctgatgtgctaggcatggttctaagtactttactt
```

Figure 2AE-3

```
2821 gtattatcccatttaatacttagaacaaccccgtgagataagtagttattatcctcattt
2881 tacacatgagggaccgaaggatagaaaagttattttcaaaggtcttgcagttaataaat
2941 ggcagagtgagcattcaagtccaggtagtcatattccagaggccacggttttaaccacta
3001 ggctctagagctcccgccgcgcccctatgcattatgttcacaatgccaatctagatgctt
3061 cctcttttgtataaagtcactgacattctttagagtgggttgggtgcatccaaaaatgta
3121 taaaaatattattataataaacttattactgcttgtagggtaattcacagttacttaccc
3181 tattcttgcttggaacatgagcctggagacccatggcagtccatatgcctccctatgcag
3241 tgaagggccctagcagtgttaacaaattgctgagatcccacggagtctttcaaaaatctc
3301 tgtagagttagtcttctccttttctcttcctgagaagttctcctgcctgcataaccattc
3361 attagggagtactttacaagcatgaaggatattagggtaagtggctaattataaatctac
3421 tctagagacatataatcatacagattattcataaaattttcagtgctgtccttccacat
3481 ttaattgcattttgctcaaactgtagaatgccctacattcccccaccccaatttgctat
3541 ttccttattaaaatagaaaattataggcaagatacaattatatgcgttcctcttcctgaa
3601 attataacatttctaaacttacccacgtaggtactactgaatccaactgccaacaataaa
3661 aagactttatttagtagaggctacctttcccaccagtgactcttttctacaactgcct
3721 tgtcagtttggtaattcacttatgattttctaatgttctcttggtgaattttattatctt
3781 gtaccctctttttttttttttttttttaaagacagagtcttgctctgtcacccaggct
3841 ggagtgcagtggcacgatctcggctcactgcaagctctgcctcccgggttcacgccattc
3901 tcctgcctcagcctcccgagtagctgggactacaggtgcccgccaccatgcccggctgat
3961 ttcttttgtatttttagtagagacggagtttcaccgtgttagccaggatggtctcgatc
4021 tcctgacctcgtgatccgcccgccttggcctccaaagtgctgggattacaggtgtgagct
4081 accgcgcccggcctattatcttgtactttctaactgagccctctattttctttatttaa
4141 taatatttctccccacttgagaatcacttgttagttcttggtaggaattcagttgggcaa
4201 tgataactttatgggcaaaaacattctattatagtgaactaatgaaaataacagcgtat
4261 tttcaatatttcttattccttaaattccactcttttaacactatgcttaaccacttaat
4321 gtgatgaaatattcctgaaagttaaatgactattaaagcatatattgttgcatgtatata
4381 ttaagtagccgatactctaaataaaaataccactgttacagataaatggggcctttaaaa
4441 atatgaaaacaaacttgtgaaaatgtataaaagatgcatctgttgtttcaaatggcact
4501 atcttcttttcagtactacaaaaacagaataattttgaagttttagaataaatgtaatat
4561 atttactataattctaaatgtttaaatgcttttctaaaaatgcaaaactatgatgtttag
4621 ttgctttattttacctctatgtgattattttcttaattgttattttttataatcattat
4681 ttttctgaaccattcttctggcctcagaagtaggactgaattctactattgctaggtgtg
4741 agaaagtggtggtgagaaccttagagcagtggagatttgctacctggtctgtgttttgag
4801 aagtgccccttagaaagttaaaagaatgtagaaaagatactcagtcttaatcctatgcaa
4861 aaaaaaaatcaagtaattgttttcctatgaggaaaataaccatgagctgtatcatgcta
4921 cttagcttttatgtaaatatttcttatgtctcctctattaagagtatttaaaatcatatt
4981 taaatatgaatctattcatgctaacattattttcaaaacatacatggaaatttagccca
5041 gattgtctacatataaggttttatttgaattgtaaatatttaaaagtatgaataaaat
```

Figure 2AE-4

```
5101  atatttataggtatttatcagagatgattattttgtgctacatacaggttggctaatgag
5161  ctctagtgttaaactacctgattaatttcttataaagcagcataaccttggcttgattaa
5221  ggaattctactttcaaaaattaatctgataatagtaacaaggtatattatactttcatta
5281  caatcaaattatagaaattacttgtgtaaaagggcttcaagaatatatccaatttttaaa
5341  tattttaatatatctcctatctgataacttaattcttctaaattaccacttgccattaag
5401  ctatttcataataaattctgtacagtttcccccaaaaaagagatttatttatgaaatat
5461  ttaaagtttctaatgtggtattttaaataaagtatcataaatgtaataagtaaatattta
5521  tttaggaatactgtgaacactgaactaattattcctgtgtcagtctatgaaatccctgtt
5581  ttgaaatacgtaaacagcctaaaatgtgttgaaattattttgtaaatccatgacttaaaa
5641  caagatacatacatagtataacacacctcacagtgttaagatttatattgtgaaatgaga
5701  caccctaccttcaattgttcatcagtgggtaaaacaaattctgatgtacattcaggacaa
5761  atgattagccctaaatgaaactgtaataatttcagtggaaactcaatctgttttacctt
5821  taaacagtgaattttacatgaatgaatgggttcttcacttttttttagtatgagaaaat
5881  tatacagtgcttaattttcagagattctttccatatgttactaaaaaatgttttgttcag
5941  cctaacatactgagtttttttaactttctaaattattgaatttccatcatgcattcatc
6001  caaaattaaggcagactgtttggattcttccagtggccagatgagctaaattaaatcaca
6061  aaagcagatgcttttgtatgatctccaaattgccaactttaaggaaatattctcttgaaa
6121  ttgtctttaaagatcttttgcagctttgcagatacccagactgagctggaactggaattt
6181  gtcttcctattgactctacttctttaaaagcggctgcccattacattcctcagctgtcct
6241  tgcagttaggtgtacatgtgactgagtgttggccagtgagatgaagtctcctcaaaggaa
6301  ggcagcatgtgtccttttcatcccttcatcttgctgctgggattgtggatataacagga
6361  gccctggcagctgtctccagaggatcaaagccacacccaaagagtaaggcagattagaga
6421  ccagaaagaccttgactacttccctacttccactgcttttcctgcatttaagccattgt
6481  aaatctgggtgtgttacatgaagtgaaaattaattctttctgcccttcagttctttatcc
6541  tgataccatttaacactgtctgaattaactagactgcaataattctttcttttgaaagct
6601  tttaaaggataatgtgcaattcacattaaaattgattttccattgtcaattagttatact
6661  cattttcctgccttgatctttcattagatattttgtatctgcttggaatatattcttc
6721  tttttaactgtgtaattggtaattactaaaactctgtaatctccaaaatattgctatcaa
6781  attacacaccatgttttctatcattctcatagatctgccttataaacatttaaataaaaa
6841  gtactatttaatgattt
```

Figure 2AF-1

The cDNA (SEQ ID. NO.: 64) and amino acid sequence (SEQ ID. NO.: 65) of 98P4B6 v.32. The start methionine is underlined. The open reading frame extends from nucleic acid 394-1866 including the stop codon.

```
   1 gccccctccgagctccccgactcctccccgcgctccacggctcttcccgactccagtcag
  61 cgttcctcgggccctcggcgccacaagctgtccgggcacgcagcccctagcggcgcgtcg
 121 ctgccaagccggcctccgcgcgcctccctccttccttctcccctggctgttcgcgatcca
 181 gcttgggtaggcggggaagcagctggagtgcgaccgccacggcagccaccctgcaaccgc
 241 cagtcggaggtgcagtccgtaggccctggcccccgggtgggcccttggggagtcggcgcc
 301 gctcccgaggagctgcaaggctcgcccctgcccggcgtggagggcgcggggggcgcggag
   1                                        M   E   S   I   S   M   M   G   S
 361 gatattcttggtgatcttggaagtgtccgtatcATGGAATCAATCTCTATGATGGGAAGC
  10 P   K   S   L   S   E   T   C   L   P   N   G   I   N   G   I   K   D   A   R
 421 CCTAAGAGCCTTAGTGAAACTTGTTTACCTAATGGCATAAATGGTATCAAAGATGCAAGG
  30 K   V   T   G   V   I   G   S   G   D   F   A   K   S   L   T   I   R   L
 481 AAGGTCACTGTAGGTGTGATTGGAAGTGGAGATTTTGCCAAATCCTTGACCATTCGACTT
  50 I   R   C   G   Y   H   V   V   I   G   S   R   N   P   K   F   A   S   E   F
 541 ATTAGATGCGGCTATCATGTGGTCATAGGAAGTAGAAATCCTAAGTTTGCTTCTGAATTT
  70 F   P   H   V   V   D   V   T   H   H   E   D   A   L   T   K   T   N   I   I
 601 TTTCCTCATGTGGTAGATGTCACTCATCATGAAGATGCTCTCACAAAAACAAATATAATA
  90 F   V   A   I   H   R   E   H   Y   T   S   L   W   D   L   R   H   L   L   V
 661 TTTGTTGCTATACACAGAGAACATTATACCTCCCTGTGGGACCTGAGACATCTGCTTGTG
 110 G   K   I   L   I   D   V   S   N   N   M   R   I   N   Q   Y   P   E   S   N
 721 GGTAAAATCCTGATTGATGTGAGCAATAACATGAGGATAAACCAGTACCCAGAATCCAAT
 130 A   E   Y   L   A   S   L   F   P   D   S   L   I   V   K   G   F   N   V   V
 781 GCTGAATATTTGGCTTCATTATTCCCAGATTCTTTGATTGTCAAAGGATTTAATGTTGTC
 150 S   A   W   A   L   Q   L   G   P   K   D   A   S   R   Q   V   Y   I   C   S
 841 TCAGCTTGGGCACTTCAGTTAGGACCTAAGGATGCCAGCCGGCAGGTTTATATATGCAGC
 170 N   N   I   Q   A   R   Q   Q   V   I   E   L   A   R   Q   L   N   F   I   P
 901 AACAATATTCAAGCGCGACAACAGGTTATTGAACTTGCCCGCCAGTTGAATTTCATTCCC
 190 I   D   L   G   S   L   S   S   A   R   E   I   E   N   L   P   R   L   F
 961 ATTGACTTGGGATCCTTATCATCAGCCAGAGAGATTGAAAATTTACCCCTACGACTCTTT
 210 T   L   W   R   G   P   V   V   V   A   I   S   L   A   T   F   F   F   L   Y
1021 ACTCTCTGGAGAGGGCCAGTGGTGGTAGCTATAAGCTTGGCCACATTTTTTTTCCTTTAT
 230 S   F   V   R   D   V   I   H   P   Y   A   R   N   Q   Q   S   D   F   Y   K
1081 TCCTTTGTCAGAGATGTGATTCATCCATATGCTAGAAACCAACAGAGTGACTTTTACAAA
 250 I   P   I   E   I   V   N   K   T   L   P   I   V   A   I   T   L   L   S   L
1141 ATTCCTATAGAGATTGTGAATAAAACCTTACCTATAGTTGCCATTACTTTGCTCTCCCTA
 270 V   Y   L   A   G   L   L   A   A   A   Y   Q   L   Y   Y   G   T   K   Y   R
```

Figure 2AF-2

```
1201 GTATACCTTGCAGGTCTTCTGGCAGCTGCTTATCAACTTTATTACGGCACCAAGTATAGG
 290  R  F  P  P  W  L  E  T  W  L  Q  C  R  K  Q  L  G  L  L  S
1261 AGATTTCCACCTTGGTTGGAAACCTGGTTACAGTGTAGAAAACAGCTTGGATTACTAAGT
 310  F  F  F  A  M  V  H  V  A  Y  S  L  C  L  P  M  R  R  S  E
1321 TTTTTCTTCGCTATGGTCCATGTTGCCTACAGCCTCTGCTTACCGATGAGAAGGTCAGAG
 330  R  Y  L  F  L  N  M  A  Y  Q  Q  V  H  A  N  I  E  N  S  W
1381 AGATATTTGTTTCTCAACATGGCTTATCAGCAGGTTCATGCAAATATTGAAAACTCTTGG
 350  N  E  E  V  W  R  I  E  M  Y  I  S  F  G  I  M  S  L  G
1441 AATGAGGAAGAAGTTTGGAGAATTGAAATGTATATCTCCTTTGGCATAATGAGCCTTGGC
 370  L  L  S  L  L  A  V  T  S  I  P  S  V  S  N  A  L  N  W  R
1501 TTACTTTCCCTCCTGGCAGTCACTTCTATCCCTTCAGTGAGCAATGCTTTAAACTGGAGA
 390  E  F  S  F  I  Q  S  T  L  G  Y  V  A  L  L  I  S  T  F  H
1561 GAATTCAGTTTTATTCAGTCTACACTTGGATATGTCGCTCTGCTCATAAGTACTTTCCAT
 410  V  L  I  Y  G  W  K  R  A  F  E  E  E  Y  Y  R  F  Y  T  P
1621 GTTTTAATTTATGGATGGAAACGAGCTTTTGAGGAAGAGTACTACAGATTTTATACACCA
 430  P  N  F  V  L  A  L  V  L  P  S  I  V  I  L  G  K  I  I  L
1681 CCAAACTTTGTTCTTGCTCTTGTTTTGCCCTCAATTGTAATTCTGGGTAAGATTATTTTA
 450  F  L  P  C  I  S  R  K  L  K  R  I  K  K  G  W  E  K  S  Q
1741 TTCCTTCCATGTATAAGCCGAAAGCTAAAACGAATTAAAAAAGGCTGGGAAAAGAGCCAA
 470  F  L  E  E  G  M  G  G  T  I  P  H  V  S  P  E  R  V  T  V
1801 TTTCTGGAAGAAGGTATGGGAGGAACAATTCCTCATGTCTCCCCGGAGAGGGTCACAGTA
 490  M  *
1861 ATGTGAtgacaaatggtgttcacagctgccatataaagttctactcatgccattattttt
1921 atgacttctacgttcagttacaagtatgctgtcaaattatcgtgggttgaaacttgttaa
1981 atgagatttcaactgacttagtgatagagttttcttcaagttaattttcacaaatgtcat
2041 gtttgccaatatgaattttctagtcaacatattattgtaatttaggtatgttttgtttt
2101 gttttgcacaactgtaaccctgttgttactttatatttcataatcaggcaaaaatactta
2161 cagttaataatatagatataatgttaaaaacaatttgcaaaccagcagaattttaagctt
2221 ttaaaataattcaatggatatacattttttctgaagattaagattttaattattcaact
2281 taaaaagtagaaatgcattattatacattttttaagaaaggacacgttatgttagcatc
2341 taggtaaggctgcatgatagcattcctatatttctctcataaaataggatttgaaggatg
2401 aaattaattgtatgaagcaatgtgattatatgaagagacacaaattaaaaagacaaatta
2461 aacctgaaattatatttaaaatatatttgagacatgaaatacatactgataatacatacc
2521 tcatgaaagattttattctttattgtgttacagagcagtttcattttcatattaatatac
2581 tgatcaggaagaggattcagtaacatttggcttccaaaactgctatctctaatacggtac
2641 caatcctaggaactgtatactagttcctacttagaacaaaagtatcaagtttgcacacaa
2701 gtaatctgccagctgacctttgtcgcaccttaaccagtcaccacttgctatggtatagga
2761 ttatactgatgttctttgagggattctgatgtgctaggcatggttctaagtactttactt
```

Figure 2AF-3

```
2821  gtattatcccatttaatacttagaacaaccccgtgagataagtagttattatcctcattt
2881  tacacatgagggaccgaaggatagaaaagttattttcaaaggtcttgcagttaataaat
2941  ggcagagtgagcattcaagtccaggtagtcatattccagaggccacggttttaaccacta
3001  ggctctagagctcccgccgcgcccctatgcattatgttcacaatgccaatctagatgctt
3061  cctcttttgtataaagtcactgacattctttagagtgggttgggtgcatccaaaaatgta
3121  taaaaatattattataataaacttattactgcttgtagggtaattcacagttacttaccc
3181  tattcttgcttggaacatgagcctggagacccatggcagtccatatgcctccctatgcag
3241  tgaagggccctagcagtgttaacaaattgctgagatcccacggagtctttcaaaaatctc
3301  tgtagagttagtcttctccttttctcttcctgagaagttctcctgcctgcataaccattc
3361  attagggagtactttacaagcatgaaggatattagggtaagtggctaattataaatctac
3421  tctagagacatataatcatacagattattcataaaattttcagtgctgtccttccacat
3481  ttaattgcattttgctcaaactgtagaatgccctacattcccccacccaatttgctat
3541  ttccttattaaaatagaaaattataggcaagatacaattatatgcgttcctcttcctgaa
3601  attataacatttctaaacttacccacgtaggtactactgaatccaactgccaacaataaa
3661  aagacttttatttagtagaggctacctttcccaccagtgactcttttctacaactgcct
3721  tgtcagtttggtaattcacttatgatttctaatgttctcttggtgaattttattatctt
3781  gtaccctcttttttttttttttttttttaaagacagagtcttgctctgtcacccaggct
3841  ggagtgcagtggcacgatctcggctcactgcaagctctgcctcccgggttcacgccattc
3901  tcctgcctcagcctcccgagtagctgggactacaggtgcccgccaccatgcccggctgat
3961  ttcttttgtatttttagtagagacggagtttcaccgtgttagccaggatggtctcgatc
4021  tcctgacctcgtgatccgcccgcttggcctccaaagtgctgggattacaggtgtgagct
4081  accgcgcccggcctattatcttgtactttctaactgagccctctattttctttatttaa
4141  taatatttctccccacttgagaatcacttgttagttcttggtaggaattcagttgggcaa
4201  tgataacttttatgggcaaaaacattctattatagtgaactaatgaaaataacagcgtat
4261  tttcaatattttcttattccttaaattccactcttttaacactatgcttaaccacttaat
4321  gtgatgaaatattcctacaagttaaatgactattaaagcatatattgttgcatgtatata
4381  ttaagtagccgatactctaaataaaaataccactgttacagataaatggggcctttaaaa
4441  atatgaaaacaaacttgtgaaaatgtataaaagatgcatctgttgtttcaaatggcact
4501  atcttcttttcagtactacaaaaacagaataattttgaagttttagaataaatgtaatat
4561  atttactataattctaaatgtttaaatgcttttctaaaaatgcaaaactatgatgtttag
4621  ttgctttatttacctctatgtgattattttcttaattgttattttttataatcattat
4681  ttttctgaaccattcttctggcctcagaagtaggactgaattctactattgctaggtgtg
4741  agaaagtggtggtgagaaccttagagcagtggagatttgctacctggtctgtgttttgag
4801  aagtgccccttagaaagttaaaagaatgtagaaaagatactcagtcttaatcctatgcaa
4861  aaaaaaaatcaagtaattgttttcctatgaggaaaataaccatgagctgtatcatgcta
4921  cttagcttttatgtaaatatttcttatgtctcctctattaagagtatttaaaatcatatt
4981  taaatatgaatctattcatgctaacattattttttcaaaacatacatggaaatttagccca
5041  gattgtctacatataaggttttttatttgaattgtaaaatatttaaaagtatgaataaaat
```

Figure 2AF-4

```
5101 atatttataggtatttatcagagatgattattttgtgctacatacaggttggctaatgag
5161 ctctagtgttaaactacctgattaatttcttataaagcagcataaccttggcttgattaa
5221 ggaattctactttcaaaaattaatctgataatagtaacaaggtatattatactttcatta
5281 caatcaaattatagaaattacttgtgtaaaagggcttcaagaatatatccaattttttaaa
5341 tattttaatatatctcctatctgataacttaattcttctaaattaccacttgccattaag
5401 ctatttcataataaattctgtacagtttcccccaaaaaagagatttatttatgaaatat
5461 ttaaagtttctaatgtggtattttaaataaagtatcataaatgtaataagtaaatattta
5521 tttaggaatactgtgaacactgaactaattattcctgtgtcagtctatgaaatccctgtt
5581 ttgaaatacgtaaacagcctaaaatgtgttgaattattttgtaaatccatgacttaaaa
5641 caagatacatacatagtataacacacctcacagtgttaagatttatattgtgaaatgaga
5701 caccctaccttcaattgttcatcagtgggtaaaacaaattctgatgtacattcaggacaa
5761 atgattagccctaaatgaaactgtaataatttcagtggaaactcaatctgttttttacctt
5821 taaacagtgaattttacatgaatgaatgggttcttcacttttttttagtatgagaaaat
5881 tatacagtgcttaattttcagagattctttccatatgttactaaaaaatgttttgttcag
5941 cctaacatactgagtttttttaactttctaaattattgaatttccatcatgcattcatc
6001 caaaattaaggcagactgtttggattcttccagtggccagatgagctaaattaaatcaca
6061 aaagcagatgcttttgtatgatctccaaattgccaactttaaggaaatattctcttgaaa
6121 ttgtctttaaagatcttttgcagctttgcagatacccagactgagctggaactggaattt
6181 gtcttcctattgactctacttctttaaaagcggctgcccattacattcctcagctgtcct
6241 tgcagttaggtgtacatgtgactgagtgttggccagtgagatgaagtctcctcaaaggaa
6301 ggcagcatgtgtccttttcatcccttcatcttgctgctgggattgtggatataacagga
6361 gccctggcagctgtctccagaggatcaaagccacacccaaagagtaaggcagattagaga
6421 ccagaaagaccttgactacttccctacttccactgcttttcctgcatttaagccattgt
6481 aaatctgggtgtgttacatgaagtgaaaattaattctttctgcccttcagttctttatcc
6541 tgataccatttaacactgtctgaattaactagactgcaataattctttcttttgaaagct
6601 tttaaaggataatgtgcaattcacattaaaattgattttccattgtcaattagttatact
6661 catttcctgccttgatctttcattagatattttgtatctgcttggaatatattatcttc
6721 ttttttaactgtgtaattggtaattactaaaactctgtaatctccaaaatattgctatcaa
6781 attacacaccatgttttctatcattctcatagatctgccttataaacatttaaataaaaa
6841 gtactatttaatgattt
```

Figure 2AG-1

The cDNA (SEQ ID. NO. : 66) and amino acid sequence (SEQ ID. NO. : 67) of 98P4B6 v.33. The start methionine is underlined. The open reading frame extends from nucleic acid 394-1866 including the stop codon.

```
   1 gccccctccgagctccccgactcctccccgcgctccacggctcttcccgactccagtcag
  61 cgttcctcgggccctcggcgccacaagctgtccgggcacgcagccctagcggcgcgtcg
 121 ctgccaagccggcctccgcgcgcctcctccttccttctccctggctgttcgcgatcca
 181 gcttgggtaggcggggaagcagctggagtgcgaccgccacggcagccaccctgcaaccgc
 241 cagtcggaggtgcagtccgtaggccctggccccgggtgggcccttggggagtcggcgcc
 301 gctcccgaggagctgcaaggctcgccctgcccggcgtggagggcgcggggggcgcggag
                                              M   E   S   I   S   M   M   G   S
 361 gatattcttggtgatcttggaagtgtccgtatcATGGAATCAATCTCTATGATGGGAAGC
  10 P   K   S   L   S   E   T   C   L   P   N   G   I   N   G   I   K   D   A   R
 421 CCTAAGAGCCTTAGTGAAACTTGTTTACCTAATGGCATAAATGGTATCAAAGATGCAAGG
  30 K   V   T   V   G   V   I   G   S   G   D   F   A   K   S   L   T   I   R   L
 481 AAGGTCACTGTAGGTGTGATTGGAAGTGGAGATTTTGCCAAATCCTTGACCATTCGACTT
  50 I   R   C   G   Y   H   V   V   I   G   S   R   N   P   K   F   A   S   E   F
 541 ATTAGATGCGGCTATCATGTGGTCATAGGAAGTAGAAATCCTAAGTTTGCTTCTGAATTT
  70 F   P   H   V   V   D   V   T   H   H   E   D   A   L   T   K   T   N   I   I
 601 TTTCCTCATGTGGTAGATGTCACTCATCATGAAGATGCTCTCACAAAAACAAATATAATA
  90 F   V   A   I   H   R   E   H   Y   T   S   L   W   D   L   R   H   L   L   V
 661 TTTGTTGCTATACACAGAGAACATTATACCTCCCTGTGGGACCTGAGACATCTGCTTGTG
 110 G   K   I   L   I   D   V   S   N   N   M   R   I   N   Q   Y   P   E   S   N
 721 GGTAAAATCCTGATTGATGTGAGCAATAACATGAGGATAAACCAGTACCCAGAATCCAAT
 130 A   E   Y   L   A   S   L   F   P   D   S   L   I   V   K   G   F   N   V   V
 781 GCTGAATATTTGGCTTCATTATTCCCAGATTCTTTGATTGTCAAAGGATTTAATGTTGTC
 150 S   A   W   A   L   Q   L   G   P   K   D   A   S   R   Q   V   Y   I   C   S
 841 TCAGCTTGGGCACTTCAGTTAGGACCTAAGGATGCCAGCCGGCAGGTTTATATATGCAGC
 170 N   N   I   Q   A   R   Q   Q   V   I   E   L   A   R   Q   L   N   F   I   P
 901 AACAATATTCAAGCGCGACAACAGGTTATTGAACTTGCCCGCCAGTTGAATTTCATTCCC
 190 I   D   L   G   S   L   S   S   A   R   E   I   E   N   L   P   L   R   L   F
 961 ATTGACTTGGGATCCTTATCATCAGCCAGAGAGATTGAAAATTTACCCCTACGACTCTTT
 210 T   L   W   R   G   P   V   V   V   A   I   S   L   A   T   F   F   F   L   Y
1021 ACTCTCTGGAGAGGGCCAGTGGTGGTAGCTATAAGCTTGGCCACATTTTTTTTCCTTTAT
 230 S   F   V   R   D   V   I   H   P   Y   A   R   N   Q   Q   S   D   F   Y   K
1081 TCCTTTGTCAGAGATGTGATTCATCCATATGCTAGAAACCAACAGAGTGACTTTTACAAA
 250 I   P   I   E   I   V   N   K   T   L   P   I   V   A   I   T   L   L   S   L
1141 ATTCCTATAGAGATTGTGAATAAAACCTTACCTATAGTTGCCATTACTTTGCTCTCCCTA
 270 V   Y   L   A   G   L   L   A   A   A   Y   Q   L   Y   Y   G   T   K   Y   R
```

Figure 2AG-2

```
1201 GTATACCTTGCAGGTCTTCTGGCAGCTGCTTATCAACTTTATTACGGCACCAAGTATAGG
 290  R  F  P  P  W  L  E  T  W  L  Q  C  R  K  Q  L  G  L  L  S
1261 AGATTTCCACCTTGGTTGGAAACCTGGTTACAGTGTAGAAAACAGCTTGGATTACTAAGT
 310  F  F  F  A  M  V  H  V  A  Y  S  L  C  L  P  M  R  R  S  E
1321 TTTTCTTCGCTATGGTCCATGTTGCCTACAGCCTCTGCTTACCGATGAGAAGGTCAGAG
 330  R  Y  L  F  L  N  M  A  Y  Q  Q  V  H  A  N  I  E  N  S  W
1381 AGATATTTGTTTCTCAACATGGCTTATCAGCAGGTTCATGCAAATATTGAAAACTCTTGG
 350  N  E  E  E  V  W  R  I  E  M  Y  I  S  F  G  I  M  S  L  G
1441 AATGAGGAAGAAGTTTGGAGAATTGAAATGTATATCTCCTTTGGCATAATGAGCCTTGGC
 370  L  L  S  L  L  A  V  T  S  I  P  S  V  S  N  A  L  N  W  R
1501 TTACTTTCCCTCCTGGCAGTCACTTCTATCCCTTCAGTGAGCAATGCTTTAAACTGGAGA
 390  E  F  S  F  I  Q  S  T  L  G  Y  V  A  L  L  I  S  T  F  H
1561 GAATTCAGTTTTATTCAGTCTACACTTGGATATGTCGCTCTGCTCATAAGTACTTTCCAT
 410  V  L  I  Y  G  W  K  R  A  F  E  E  E  Y  Y  R  F  Y  T  P
1621 GTTTTAATTTATGGATGGAAACGAGCTTTTGAGGAAGAGTACTACAGATTTTATACACCA
 430  P  N  F  V  L  A  L  V  P  S  I  V  I  L  G  K  I  I  L
1681 CCAAACTTTGTTCTTGCTCTTGTTTTGCCCTCAATTGTAATTCTGGGTAAGATTATTTTA
 450  F  L  P  C  I  S  R  K  L  K  R  I  K  K  G  W  E  K  S  Q
1741 TTCCTTCCATGTATAAGCCGAAAGCTAAAACGAATTAAAAAAGGCTGGGAAAAGAGCCAA
 470  F  L  E  E  G  M  G  G  T  I  P  H  V  S  P  E  R  V  T  V
1801 TTTCTGGAAGAAGGTATGGGAGGAACAATTCCTCATGTCTCCCCGGAGAGGGTCACAGTA
 490  M  *
1861 ATGTGAtgacaaatggtgttcacagctgccatataaagttctactcatgccattattttt
1921 atgacttctacgttcagttacaagtatgctgtcaaattatcgtgggttgaaacttgttaa
1981 atgagatttcaactgacttagtgatagagttttcttcaagttaattttcacaaatgtcat
2041 gtttgccaatatgaattttctagtcaacatattattgtaatttaggtatgttttgtttt
2101 gttttgcacaactgtaaccctgttgttactttatatttcataatcaggcaaaaatactta
2161 cagttaataatatagatataatgttaaaaacaatttgcaaaccagcagaattttaagctt
2221 ttaaaataattcaatggatatacattttttctgaagattaagatttaattattcaact
2281 taaaagtagaaatgcattattatacattttttaagaaaggacacgttatgttagcatc
2341 taggtaaggctgcatgatagcattcctatatttctctcataaaataggatttgaaggatg
2401 aaattaattgtatgaagcaatgtgattatatgaagagacacaaattaaaaagacaaatta
2461 aacctgaaattatatttaaaatatatttgagacatgaaatacatactgataatacatacc
2521 tcatgaaagattttattctttattgtgttacagagcagtttcattttcatattaatatac
2581 tgatcaggaagaggattcagtaacatttggcttccaaaactgctatctctaatacggtac
2641 caatcctaggaactgtatactagttcctacttagaacaaaagtatcaagtttgcacacaa
2701 gtaatctgccagctgacctttgtcgcaccttaaccagtcaccacttgctatggtatagga
2761 ttatactgatgttctttgagggattctgatgtgctaggcatggttctaagtactttactt
```

Figure 2AG-3

```
2821 gtattatcccatttaatacttagaacaacccegtgagataagtagttattatcctcattt
2881 tacacatgagggaccgaaggatagaaaagttattttttcaaaggtcttgcagttaataaat
2941 ggcagagtgagcattcaagtccaggtagtcatattccagaggccacggttttaaccacta
3001 ggctctagagctcccgccgcgcccctatgcattatgttcacaatgccaatctagatgctt
3061 cctcttttgtataaagtcactgacattctttagagtgggttgggtgcatccaaaaatgta
3121 taaaaatattattataataaacttattactgcttgtagggtaattcacagttacttaccc
3181 tattcttgcttggaacatgagcctggagacccatggcagtccatatgcctccctatgcag
3241 tgaagggccctagcagtgttaacaaattgctgagatcccacggagtctttcaaaaatctc
3301 tgtagagttagtcttctccttttctcttcctgagaagttctcctgcctgcataaccattc
3361 attagggagtactttacaagcatgaaggatattagggtaagtggctaattataaatctac
3421 tctagagacatataatcatacagattattcataaaattttttcagtgctgtccttccacat
3481 ttaattgcattttgctcaaactgtagaatgccctacattcccccccaccccaatttgctat
3541 ttccttattaaaatagaaaattataggcaagatacaattatatgcgttcctcttcctgaa
3601 attataacatttctaaacttacccacgtaggtactactgaatccaactgccaacaataaa
3661 aagactttttatttagtagaggctaccttttcccaccagtgactctttttctacaactgcct
3721 tgtcagtttggtaattcacttatgattttctaatgttctcttggtgaattttattatctt
3781 gtaccctctttttttttttttttttttttaaagacagagtcttgctctgtcacccaggct
3841 ggagtgcagtggcacgatctcggctcactgcaagctctgcctcccgggttcacgccattc
3901 tcctgcctcagcctcccgagtagctgggactacaggtgcccgccaccatgcccggctgat
3961 ttcttttttgtattttttagtagagacggagtttcaccgtgttagccaggatggtctcgatc
4021 tcctgacctcgtgatccgcccgccttggcctccaaagtgctgggattacaggtgtgagct
4081 accgcgcccggcctattatcttgtactttctaactgagccctctattttctttatttttaa
4141 taatatttctccccacttgagaatcacttgttagttcttggtaggaattcagttgggcaa
4201 tgataacttttatgggcaaaaacattctattatagtgaactaatgaaaataacagcgtat
4261 tttcaatatttttcttattccttaaattccactcttttaacactatgcttaaccacttaat
4321 gtgatgaaatattcctaaaagttaaatgactattaaagcatatattgttgcatgtatata
4381 ttaagtagccgatactctaaataaaaataccactgttacagataaatggggcctttaaaa
4441 atatgaaaaacaaacttgtgaaaatgtataaaagatgcatctgttgtttcaaatggcact
4501 gtcttcttttcagtactacaaaaacagaataattttgaagttttagaataaatgtaatat
4561 atttactataattctaaatgtttaaatgcttttctaaaaatgcaaaactatgatgtttag
4621 ttgctttattttacctctatgtgattatttttcttaattgttatttttataatcattat
4681 ttttctgaaccattcttctggcctcagaagtaggactgaattctactattgctaggtgtg
4741 agaaagtggtggtgagaaccttagagcagtggagatttgctacctggtctgtgttttgag
4801 aagtgcccctttagaaagttaaaagaatgtagaaaagatactcagtcttaatcctatgcaa
4861 aaaaaaaaatcaagtaattgttttcctatgaggaaaataaccatgagctgtatcatgcta
4921 cttagcttttatgtaaatatttcttatgtctcctctattaagagtatttaaaatcatatt
4981 taaatatgaatctattcatgctaacattatttttcaaaacatacatggaaatttagccca
5041 gattgtctacatataaggttttttatttgaattgtaaaatatttaaaagtatgaataaaat
```

Figure 2AG-4

```
5101 atatttataggtatttatcagagatgattattttgtgctacatacaggttggctaatgag
5161 ctctagtgttaaactacctgattaatttcttataaagcagcataaccttggcttgattaa
5221 ggaattctactttcaaaaattaatctgataatagtaacaaggtatattatactttcatta
5281 caatcaaattatagaaattacttgtgtaaaagggcttcaagaatatatccaatttttaaa
5341 tattttaatatatctcctatctgataacttaattcttctaaattaccacttgccattaag
5401 ctatttcataataaattctgtacagtttccccccaaaaaagagatttatttatgaaatat
5461 ttaaagtttctaatgtggtattttaaataaagtatcataaatgtaataagtaaatattta
5521 tttaggaatactgtgaacactgaactaattattcctgtgtcagtctatgaaatccctgtt
5581 ttgaaatacgtaaacagcctaaaatgtgttgaaattatttgtaaatccatgacttaaaa
5641 caagatacatacatagtataacacacctcacagtgttaagatttatattgtgaaatgaga
5701 caccctaccttcaattgttcatcagtgggtaaaacaaattctgatgtacattcaggacaa
5761 atgattagccctaaatgaaactgtaataatttcagtggaaactcaatctgttttaccttt
5821 taaacagtgaattttacatgaatgaatgggttcttcacttttttttagtatgagaaaat
5881 tatacagtgcttaattttcagagattctttccatatgttactaaaaaatgttttgttcag
5941 cctaacatactgagttttttttaactttctaaattattgaatttccatcatgcattcatc
6001 caaaattaaggcagactgtttggattcttccagtggccagatgagctaaattaaatcaca
6061 aaagcagatgcttttgtatgatctccaaattgccaactttaaggaaatattctcttgaaa
6121 ttgtctttaaagatcttttgcagctttgcagatacccagactgagctggaactggaattt
6181 gtcttcctattgactctacttctttaaaagcggctgcccattacattcctcagctgtcct
6241 tgcagttaggtgtacatgtgactgagtgttggccagtgagatgaagtctcctcaaaggaa
6301 ggcagcatgtgtccttttcatcccttcatcttgctgctgggattgtggatataacagga
6361 gccctggcagctgtctccagaggatcaaagccacacccaaagagtaaggcagattagaga
6421 ccagaaagaccttgactacttccctacttccactgcttttcctgcatttaagccattgt
6481 aaatctgggtgtgttacatgaagtgaaaattaattctttctgcccttcagttctttatcc
6541 tgataccatttaacactgtctgaattaactagactgcaataattctttcttttgaaagct
6601 tttaaaggataatgtgcaattcacattaaaattgattttccattgtcaattagttatact
6661 catttcctgccttgatctttcattagatattttgtatctgcttggaatatattatcttc
6721 ttttttaactgtgtaattggtaattactaaaactctgtaatctccaaaatattgctatcaa
6781 attacacaccatgttttctatcattctcatagatctgccttataaacatttaataaaaa
6841 gtactatttaatgattt
```

Figure 2AH-1

The cDNA (SEQ ID. NO. : 68) and amino acid sequence (SEQ ID. NO. : 69) of 98P4B6 v.34. The start methionine is underlined. The open reading frame extends from nucleic acid 394-1866 including the stop codon.

```
   1 gccccctccgagctccccgactcctccccgcgctccacggctcttcccgactccagtcag
  61 cgttcctcgggccctcggcgccacaagctgtccgggcacgcagccctagcggcgcgtcg
 121 ctgccaagccggcctccgcgcgcctccctccttccttctccctggctgttcgcgatcca
 181 gcttgggtaggcggggaagcagctggagtgcgaccgccacggcagccaccctgcaaccgc
 241 cagtcggaggtgcagtccgtaggccctggcccccgggtgggcccttggggagtcggcgcc
 301 gctcccgaggagctgcaaggctcgcccctgcccggcgtggagggcgcggggggcgcggag
   1                                             M   E   S   I   S   M   M   G   S
 361 gatattcttggtgatcttggaagtgtccgtatcATGGAATCAATCTCTATGATGGGAAGC
  10 P   K   S   L   S   E   T   C   L   P   N   G   I   N   G   I   K   D   A   R
 421 CCTAAGAGCCTTAGTGAAACTTGTTTACCTAATGGCATAAATGGTATCAAAGATGCAAGG
  30 K   V   T   V   G   V   I   G   S   G   D   F   A   K   S   L   T   I   R   L
 481 AAGGTCACTGTAGGTGTGATTGGAAGTGGAGATTTTGCCAAATCCTTGACCATTCGACTT
  50 I   R   C   G   Y   H   V   V   I   G   S   R   N   P   K   F   A   S   E   F
 541 ATTAGATGCGGCTATCATGTGGTCATAGGAAGTAGAAATCCTAAGTTTGCTTCTGAATTT
  70 F   P   H   V   V   D   V   T   H   H   E   D   A   L   T   K   T   N   I   I
 601 TTTCCTCATGTGGTAGATGTCACTCATCATGAAGATGCTCTCACAAAAACAAATATAATA
  90 F   V   A   I   H   R   E   H   Y   T   S   L   W   D   L   R   H   L   L   V
 661 TTTGTTGCTATACACAGAGAACATTATACCTCCCTGTGGGACCTGAGACATCTGCTTGTG
 110 G   K   I   L   I   D   V   S   N   N   M   R   I   N   Q   Y   P   E   S   N
 721 GGTAAAATCCTGATTGATGTGAGCAATAACATGAGGATAAACCAGTACCCAGAATCCAAT
 130 A   E   Y   L   A   S   L   F   P   D   S   L   I   V   K   G   F   N   V   V
 781 GCTGAATATTTGGCTTCATTATTCCCAGATTCTTTGATTGTCAAAGGATTTAATGTTGTC
 150 S   A   W   A   L   Q   L   G   P   K   D   A   S   R   Q   V   Y   I   C   S
 841 TCAGCTTGGGCACTTCAGTTAGGACCTAAGGATGCCAGCCGGCAGGTTTATATATGCAGC
 170 N   N   I   Q   A   R   Q   Q   V   I   E   L   A   R   Q   L   N   F   I   P
 901 AACAATATTCAAGCGCGACAACAGGTTATTGAACTTGCCCGCCAGTTGAATTTCATTCCC
 190 I   D   L   G   S   L   S   S   A   R   E   I   E   N   L   P   L   R   L   F
 961 ATTGACTTGGGATCCTTATCATCAGCCAGAGAGATTGAAAATTTACCCCTACGACTCTTT
 210 T   L   W   R   G   P   V   V   V   A   I   S   L   A   T   F   F   F   L   Y
1021 ACTCTCTGGAGAGGGCCAGTGGTGGTAGCTATAAGCTTGGCCACATTTTTTTTCCTTTAT
 230 S   F   V   R   D   V   I   H   P   Y   A   R   N   Q   Q   S   D   F   Y   K
1081 TCCTTTGTCAGAGATGTGATTCATCCATATGCTAGAAACCAACAGAGTGACTTTTACAAA
 250 I   P   I   E   I   V   N   K   T   L   P   I   V   A   I   T   L   L   S   L
1141 ATTCCTATAGAGATTGTGAATAAAACCTTACCTATAGTTGCCATTACTTTGCTCTCCCTA
 270 V   Y   L   A   G   L   L   A   A   A   Y   Q   L   Y   Y   G   T   K   Y   R
```

Figure 2AH-2

```
1201 GTATACCTTGCAGGTCTTCTGGCAGCTGCTTATCAACTTTATTACGGCACCAAGTATAGG
 290  R  F  P  P  W  L  E  T  W  L  Q  C  R  K  Q  L  G  L  L  S
1261 AGATTTCCACCTTGGTTGGAAACCTGGTTACAGTGTAGAAAACAGCTTGGATTACTAAGT
 310  F  F  F  A  M  V  H  V  A  Y  S  L  C  L  P  M  R  R  S  E
1321 TTTTTCTTCGCTATGGTCCATGTTGCCTACAGCCTCTGCTTACCGATGAGAAGGTCAGAG
 330  R  Y  L  F  L  N  M  A  Y  Q  Q  V  H  A  N  I  E  N  S  W
1381 AGATATTTGTTTCTCAACATGGCTTATCAGCAGGTTCATGCAAATATTGAAAACTCTTGG
 350  N  E  E  V  W  R  I  E  M  Y  I  S  F  G  I  M  S  L  G
1441 AATGAGGAAGAAGTTTGGAGAATTGAAATGTATATCTCCTTTGGCATAATGAGCCTTGGC
 370  L  L  S  L  L  A  V  T  S  I  P  S  V  S  N  A  L  N  W  R
1501 TTACTTTCCCTCCTGGCAGTCACTTCTATCCCTTCAGTGAGCAATGCTTTAAACTGGAGA
 390  E  F  S  F  I  Q  S  T  L  G  Y  V  A  L  L  I  S  T  F  H
1561 GAATTCAGTTTTATTCAGTCTACACTTGGATATGTCGCTCTGCTCATAAGTACTTTCCAT
 410  V  L  I  Y  G  W  K  R  A  F  E  E  E  Y  Y  R  F  Y  T  P
1621 GTTTTAATTTATGGATGGAAACGAGCTTTTGAGGAAGAGTACTACAGATTTTATACACCA
 430  P  N  F  V  L  A  L  V  L  P  S  I  V  I  L  G  K  I  I  L
1681 CCAAACTTTGTTCTTGCTCTTGTTTTGCCCTCAATTGTAATTCTGGGTAAGATTATTTTA
 450  F  L  P  C  I  S  R  K  L  K  R  I  K  K  G  W  E  K  S  Q
1741 TTCCTTCCATGTATAAGCCGAAAGCTAAAACGAATTAAAAAAGGCTGGGAAAAGAGCCAA
 470  F  L  E  E  G  M  G  G  T  I  P  H  V  S  P  E  R  V  T  V
1801 TTTCTGGAAGAAGGTATGGGAGGAACAATTCCTCATGTCTCCCCGGAGAGGGTCACAGTA
 490  M  *
1861 ATGTGAtgacaaatggtgttcacagctgccatataaagttctactcatgccattattttt
1921 atgacttctacgttcagttacaagtatgctgtcaaattatcgtgggttgaaacttgttaa
1981 atgagatttcaactgacttagtgatagagttttcttcaagttaattttcacaaatgtcat
2041 gtttgccaatatgaattttctagtcaacatattattgtaatttaggtatgttttgtttt
2101 gttttgcacaactgtaaccctgttgttactttatatttcataatcaggcaaaaatactta
2161 cagttaataatatagatataatgttaaaaacaatttgcaaaccagcagaattttaagctt
2221 ttaaaataattcaatggatatacattttttctgaagattaagatttaattattcaact
2281 taaaaagtagaaatgcattattatacatttttttaagaaaggacacgttatgttagcatc
2341 taggtaaggctgcatgatagcattcctatatttctctcataaaataggatttgaaggatg
2401 aaattaattgtatgaagcaatgtgattatatgaagagacacaaattaaaaagacaaatta
2461 aacctgaaattatatttaaaatatatttgagacatgaaatacatactgataatacatacc
2521 tcatgaaagatttttattctttattgtgttacagagcagtttcattttcatattaatatac
2581 tgatcaggaagaggattcagtaacatttggcttccaaaactgctatctctaatacggtac
2641 caatcctaggaactgtatactagttcctacttagaacaaaagtatcaagtttgcacacaa
2701 gtaatctgccagctgacctttgtcgcaccttaaccagtcaccacttgctatggtatagga
2761 ttatactgatgttctttgagggattctgatgtgctaggcatggttctaagtactttactt
```

Figure 2AH-3

```
2821 gtattatcccatttaatacttagaacaaccccgtgagataagtagttattatcctcattt
2881 tacacatgagggaccgaaggatagaaaagttattttttcaaaggtcttgcagttaataaat
2941 ggcagagtgagcattcaagtccaggtagtcatattccagaggccacggttttaaccacta
3001 ggctctagagctcccgccgcgcccctatgcattatgttcacaatgccaatctagatgctt
3061 cctcttttgtataaagtcactgacattctttagagtgggttgggtgcatccaaaaatgta
3121 taaaaatattattataataaacttattactgcttgtagggtaattcacagttacttaccc
3181 tattcttgcttggaacatgagcctggagacccatggcagtccatatgcctccctatgcag
3241 tgaagggccctagcagtgttaacaaattgctgagatcccacggagtctttcaaaaatctc
3301 tgtagagttagtcttctccttttctcttcctgagaagttctcctgcctgcataaccattc
3361 attagggagtactttacaagcatgaaggatattagggtaagtggctaattataaatctac
3421 tctagagacatataatcatacagattattcataaaattttttcagtgctgtccttccacat
3481 ttaattgcattttgctcaaactgtagaatgccctacattccccccaccccaatttgctat
3541 ttccttattaaaatagaaaattataggcaagatacaattatatgcgttcctcttcctgaa
3601 attataacatttctaaacttacccacgtaggtactactgaatccaactgccaacaataaa
3661 aagctttttatttagtagaggctacctttcccaccagtgactcttttctacaactgcct
3721 tgtcagtttggtaattcacttatgattttctaatgttctcttggtgaattttattatctt
3781 gtaccctctttttttttttttttttttaaagacagagtcttgctctgtcacccaggct
3841 ggagtgcagtggcacgatctcggctcactgcaagctctgcctcccgggttcacgccattc
3901 tcctgcctcagcctcccgagtagctgggactacaggtgcccgccaccatgcccggctgat
3961 ttctttttgtattttttagtagagacggagtttcaccgtgttagccaggatggtctcgatc
4021 tcctgacctcgtgatccgcccgccttggcctccaaagtgctgggattacaggtgtgagct
4081 accgcgcccggcctattatcttgtactttctaactgagccctctattttctttattttaa
4141 taatatttctccccacttgagaatcacttgttagttcttggtaggaattcagttgggcaa
4201 tgataacttttatgggcaaaaacattctattatagtgaactaatgaaaataacagcgtat
4261 tttcaatattttcttattccttaaattccactcttttaacactatgcttaaccacttaat
4321 gtgatgaaatattcctaaaagttaaatgactattaaagcatatattgttgcatgtatata
4381 ttaagtagccgatactctaaataaaaataccactgttacagataaatggggcctttaaaa
4441 atatgaaaacaaacttgtgaaaatgtataaaagatgcatctgttgtttcaaatggcact
4501 atctttttttcagtactacaaaaacagaataattttgaagttttagaataaatgtaatat
4561 atttactataattctaaatgtttaaatgcttttctaaaaatgcaaaactatgatgtttag
4621 ttgctttattttacctctatgtgattattttttcttaattgttatttttttataatcattat
4681 ttttctgaaccattcttctggcctcagaagtaggactgaattctactattgctaggtgtg
4741 agaaagtggtggtgagaaccttagagcagtggagatttgctacctggtctgtgttttgag
4801 aagtgccccttagaaagttaaagaatgtagaaaagatactcagtcttaatcctatgcaa
4861 aaaaaaaatcaagtaattgttttcctatgaggaaaataaccatgagctgtatcatgcta
4921 cttagctttatgtaaatattcttatgtctcctctattaagagtatttaaaatcatatt
4981 taaatatgaatctattcatgctaacattattttttcaaaacatacatggaaatttagccca
5041 gattgtctacatataaggttttttatttgaattgtaaaatatttaaaagtatgaataaaat
```

Figure 2AH-4

```
5101 atatttataggtatttatcagagatgattattttgtgctacatacaggttggctaatgag
5161 ctctagtgttaaactacctgattaatttcttataaagcagcataaccttggcttgattaa
5221 ggaattctactttcaaaaattaatctgataatagtaacaaggtatattatactttcatta
5281 caatcaaattatagaaattacttgtgtaaaagggcttcaagaatatatccaattttaaa
5341 tattttaatatatctcctatctgataacttaattcttctaaattaccacttgccattaag
5401 ctatttcataataaattctgtacagtttcccccaaaaaagagatttatttatgaaatat
5461 ttaaagtttctaatgtggtattttaaataaagtatcataaatgtaataagtaaatattta
5521 tttaggaatactgtgaacactgaactaattattcctgtgtcagtctatgaaatccctgtt
5581 ttgaaatacgtaaacagcctaaaatgtgttgaaattattttgtaaatccatgacttaaaa
5641 caagatacatacatagtataacacacctcacagtgttaagatttatattgtgaaatgaga
5701 caccctaccttcaattgttcatcagtgggtaaaacaaattctgatgtacattcaggacaa
5761 atgattagccctaaatgaaactgtaataatttcagtggaaactcaatctgttttacctt
5821 taaacagtgaattttacatgaatgaatgggttcttcacttttttttagtatgagaaaat
5881 tatacagtgcttaattttcagagattctttccatatgttactaaaaaatgttttgttcag
5941 cctaacatactgagttttttttaactttctaaattattgaatttccatcatgcattcatc
6001 caaaattaaggcagactgtttggattcttccagtggccagatgagctaaattaaatcaca
6061 aaagcagatgcttttgtatgatctccaaattgccaactttaaggaaatattctcttgaaa
6121 ttgtctttaaagatcttttgcagctttgcagatacccagactgagctggaactggaattt
6181 gtcttcctattgactctacttctttaaaagcggctgcccattacattcctcagctgtcct
6241 tgcagttaggtgtacatgtgactgagtgttggccagtgagatgaagtctcctcaaaggaa
6301 ggcagcatgtgtccttttcatcccttcatcttgctgctgggattgtggatataacagga
6361 gccctggcagctgtctccagaggatcaaagccacacccaaagagtaaggcagattagaga
6421 ccagaaagaccttgactacttccctacttccactgcttttcctgcatttaagccattgt
6481 aaatctgggtgtgttacatgaagtgaaaattaattctttctgcccttcagttctttatcc
6541 tgataccatttaacactgtctgaattaactagactgcaataattctttcttttgaaagct
6601 tttaaaggataatgtgcaattcacattaaaattgattttccattgtcaattagttatact
6661 catttcctgccttgatctttcattagatattttgtatctgcttggaatatattatcttc
6721 tttttaactgtgtaattggtaattactaaaactctgtaatctccaaaatattgctatcaa
6781 attacacaccatgttttctatcattctcatagatctgccttataaacatttaaataaaaa
6841 gtactatttaatgattt
```

Figure 2AI-1

The cDNA (SEQ ID. NO.: 70) and amino acid sequence (SEQ ID. NO.: 71) of 98P4B6 v.35. The start methionine is underlined. The open reading frame extends from nucleic acid 394-1866 including the stop codon.

```
   1 gccccctccgagctccccgactcctccccgcgctccacggctcttcccgactccagtcag
  61 cgttcctcgggccctcggcgccacaagctgtccgggcacgcagcccctagcggcgcgtcg
 121 ctgccaagccggcctccgcgcgcctcctccttccttctccccggctgttcgcgatcca
 181 gcttgggtaggcggggaagcagctggagtgcgaccgccacggcagccaccctgcaaccgc
 241 cagtcggaggtgcagtccgtaggccctggccccgggtgggcccttggggagtcggcgcc
 301 gctcccgaggagctgcaaggctcgccctgcccggcgtggagggcgcggggggcgcggag
   1                                             M  E  S  I  S  M  M  G  S
 361 gatattcttggtgatcttggaagtgtccgtatcATGGAATCAATCTCTATGATGGGAAGC
  10 P  K  S  L  S  E  T  C  L  P  N  G  I  N  G  I  K  D  A  R
 421 CCTAAGAGCCTTAGTGAAACTTGTTTACCTAATGGCATAAATGGTATCAAAGATGCAAGG
  30 K  V  T  V  G  V  I  G  S  G  D  F  A  K  S  L  T  I  R  L
 481 AAGGTCACTGTAGGTGTGATTGGAAGTGGAGATTTTGCCAAATCCTTGACCATTCGACTT
  50 I  R  C  G  Y  H  V  V  I  G  S  R  N  P  K  F  A  S  E  F
 541 ATTAGATGCGGCTATCATGTGGTCATAGGAAGTAGAAATCCTAAGTTTGCTTCTGAATTT
  70 F  P  H  V  V  D  V  T  H  H  E  D  A  L  T  K  T  N  I  I
 601 TTTCCTCATGTGGTAGATGTCACTCATCATGAAGATGCTCTCACAAAAACAAATATAATA
  90 F  V  A  I  H  R  E  H  Y  T  S  L  W  D  L  R  H  L  L  V
 661 TTTGTTGCTATACACAGAGAACATTATACCTCCCTGTGGGACCTGAGACATCTGCTTGTG
 110 G  K  I  L  I  D  V  S  N  N  M  R  I  N  Q  Y  P  E  S  N
 721 GGTAAAATCCTGATTGATGTGAGCAATAACATGAGGATAAACCAGTACCCAGAATCCAAT
 130 A  E  Y  L  A  S  L  F  P  D  S  L  I  V  K  G  F  N  V  V
 781 GCTGAATATTTGGCTTCATTATTCCCAGATTCTTTGATTGTCAAAGGATTTAATGTTGTC
 150 S  A  W  A  L  Q  G  P  K  D  A  S  R  Q  V  Y  I  C  S
 841 TCAGCTTGGGCACTTCAGTTAGGACCTAAGGATGCCAGCCGGCAGGTTTATATATGCAGC
 170 N  N  I  Q  A  R  Q  Q  V  I  E  L  A  R  Q  L  N  F  I  P
 901 AACAATATTCAAGCGCGACAACAGGTTATTGAACTTGCCCGCCAGTTGAATTTCATTCCC
 190 I  D  L  G  S  L  S  S  A  R  E  I  E  N  L  P  L  R  L  F
 961 ATTGACTTGGGATCCTTATCATCAGCCAGAGAGATTGAAAATTTACCCCTACGACTCTTT
 210 T  L  W  R  G  P  V  V  V  A  I  S  L  A  T  F  F  F  L  Y
1021 ACTCTCTGGAGAGGGCCAGTGGTGGTAGCTATAAGCTTGGCCACATTTTTTTCCTTTAT
 230 S  F  V  R  D  V  I  H  P  Y  A  R  N  Q  Q  S  D  F  Y  K
1081 TCCTTTGTCAGAGATGTGATTCATCCATATGCTAGAAACCAACAGAGTGACTTTTACAAA
 250 I  P  I  E  I  V  N  K  T  L  P  I  V  A  I  T  L  L  S  L
1141 ATTCCTATAGAGATTGTGAATAAAACCTTACCTATAGTTGCCATTACTTTGCTCTCCCTA
 270 V  Y  L  A  G  L  L  A  A  A  Y  Q  L  Y  Y  G  T  K  Y  R
```

Figure 2AI-2

```
1201 GTATACCTTGCAGGTCTTCTGGCAGCTGCTTATCAACTTTATTACGGCACCAAGTATAGG
 290  R   F   P   P   W   L   E   T   W   L   Q   C   R   K   Q   L   G   L   L   S
1261 AGATTTCCACCTTGGTTGGAAACCTGGTTACAGTGTAGAAAACAGCTTGGATTACTAAGT
 310  F   F   F   A   M   V   H   V   A   Y   S   L   C   L   P   M   R   R   S   E
1321 TTTTTCTTCGCTATGGTCCATGTTGCCTACAGCCTCTGCTTACCGATGAGAAGGTCAGAG
 330  R   Y   L   F   L   N   M   A   Y   Q   Q   V   H   A   N   I   E   N   S   W
1381 AGATATTTGTTTCTCAACATGGCTTATCAGCAGGTTCATGCAAATATTGAAAACTCTTGG
 350  N   E   E   V   W   R   I   E   M   Y   I   S   F   G   I   M   S   L   G
1441 AATGAGGAAGAAGTTTGGAGAATTGAAATGTATATCTCCTTTGGCATAATGAGCCTTGGC
 370  L   L   S   L   L   A   V   T   S   I   P   S   V   S   N   A   L   N   W   R
1501 TTACTTTCCCTCCTGGCAGTCACTTCTATCCCTTCAGTGAGCAATGCTTTAAACTGGAGA
 390  E   F   S   F   I   Q   S   T   L   G   Y   V   A   L   L   I   S   T   F   H
1561 GAATTCAGTTTTATTCAGTCTACACTTGGATATGTCGCTCTGCTCATAAGTACTTTCCAT
 410  V   L   I   Y   G   W   K   R   A   F   E   E   E   Y   Y   R   F   Y   T   P
1621 GTTTTAATTTATGGATGGAAACGAGCTTTTGAGGAAGAGTACTACAGATTTTATACACCA
 430  P   N   F   V   L   A   L   V   L   P   S   I   V   I   L   G   K   I   I   L
1681 CCAAACTTTGTTCTTGCTCTTGTTTTGCCCTCAATTGTAATTCTGGGTAAGATTATTTTA
 450  F   L   P   C   I   S   R   K   L   K   R   I   K   K   G   W   E   K   S   Q
1741 TTCCTTCCATGTATAAGCCGAAAGCTAAAACGAATTAAAAAAGGCTGGGAAAAGAGCCAA
 470  F   L   E   E   G   M   G   G   T   I   P   H   V   S   P   E   R   V   T   V
1801 TTTCTGGAAGAAGGTATGGGAGGAACAATTCCTCATGTCTCCCCGGAGAGGGTCACAGTA
 490  M   *
1861 ATGTGAtgacaaatggtgttcacagctgccatataaagttctactcatgccattattttt
1921 atgacttctacgttcagttacaagtatgctgtcaaattatcgtgggttgaaacttgttaa
1981 atgagatttcaactgacttagtgatagagttttcttcaagttaattttcacaaatgtcat
2041 gtttgccaatatgaattttttctagtcaacatattattgtaatttaggtatgttttgtttt
2101 gttttgcacaactgtaaccctgttgttactttatatttcataatcaggcaaaaatactta
2161 cagttaataatatagatataatgttaaaaacaatttgcaaaccagcagaattttaagctt
2221 ttaaaataattcaatggatatacatttttttctgaagattaagattttaattattcaact
2281 taaaaagtagaaatgcattattatacattttttaagaaaggacacgttatgttagcatc
2341 taggtaaggctgcatgatagcattcctatatttctctcataaaataggatttgaaggatg
2401 aaattaattgtatgaagcaatgtgattatatgaagagacacaaattaaaaagacaaatta
2461 aacctgaaattatatttaaaatatatttgagacatgaaatacatactgataatacatacc
2521 tcatgaaagattttattctttattgtgttacagagcagtttcattttcatattaatatac
2581 tgatcaggaagaggattcagtaacatttggcttccaaaactgctatctctaatacggtac
2641 caatcctaggaactgtatactagttcctacttagaacaaaagtatcaagtttgcacacaa
2701 gtaatctgccagctgacctttgtcgcaccttaaccagtcaccacttgctatggtatagga
2761 ttatactgatgttctttgagggattctgatgtgctaggcatggttctaagtactttactt
```

Figure 2AI-3

```
2821 gtattatcccatttaatacttagaacaaccccgtgagataagtagttattatcctcattt
2881 tacacatgagggaccgaaggatagaaaagttattttttcaaaggtcttgcagttaataaat
2941 ggcagagtgagcattcaagtccaggtagtcatattccagaggccacggttttaaccacta
3001 ggctctagagctcccgccgcgcccctatgcattatgttcacaatgccaatctagatgctt
3061 cctcttttgtataaagtcactgacattctttagagtgggttgggtgcatccaaaaatgta
3121 taaaaatattattataataaacttattactgcttgtagggtaattcacagttacttaccc
3181 tattcttgcttggaacatgagcctggagacccatggcagtccatatgcctccctatgcag
3241 tgaagggccctagcagtgttaacaaattgctgagatcccacggagtctttcaaaaatctc
3301 tgtagagttagtcttctccttttctcttcctgagaagttctcctgcctgcataaccattc
3361 attagggagtactttacaagcatgaaggatattagggtaagtggctaattataaatctac
3421 tctagagacatataatcatacagattattcataaaattttcagtgctgtccttccacat
3481 ttaattgcattttgctcaaactgtagaatgccctacattccccccaccccaatttgctat
3541 ttccttattaaaatagaaaattataggcaagatacaattatatgcgttcctcttcctgaa
3601 attataacatttctaaacttacccacgtaggtactactgaatccaactgccaacaataaa
3661 aagactttatttagtagaggctacctttcccaccagtgactcttttctacaactgcct
3721 tgtcagtttggtaattcacttatgattttctaatgttctcttggtgaatttattatctt
3781 gtaccctctttttttttttttttttttaaagacagagtcttgctctgtcacccaggct
3841 ggagtgcagtggcacgatctcggctcactgcaagctctgcctcccgggttcacgccattc
3901 tcctgcctcagcctcccgagtagctgggactacaggtgcccgccaccatgcccggctgat
3961 ttcttttgtatttttagtagagacggagtttcaccgtgttagccaggatggtctcgatc
4021 tcctgacctcgtgatccgcccgccttggcctccaaagtgctgggattacaggtgtgagct
4081 accgcgcccggcctattatcttgtactttctaactgagccctctattttctttatttaa
4141 taatatttctccccacttgagaatcacttgttagttcttggtaggaattcagttgggcaa
4201 tgataactttttatgggcaaaaacattctattatagtgaactaatgaaaataacagcgtat
4261 tttcaatattttcttattccttaaattccactcttttaacactatgcttaaccacttaat
4321 gtgatgaaatattcctaaaagttaaatgactattaaagcatatattgttgcatgtatata
4381 ttaagtagccgatactctaaataaaaataccactgttacagataaatggggcctttaaaa
4441 atatgaaaaacaaacttgtgaaaatgtataaaagatgcatctgttgtttcaaatggcact
4501 atcttcttttcagtactacaaaaacagaataattttgaagttttagaataaatgtaatat
4561 atttactataattctaaatgtttaaatgcttttctaaaaatgcaaaactatgatgtttag
4621 ttgctttattttacctctatgtgattattttttcttaattgttattttttataatcattat
4681 ttttctgaaccattcttctggcctcagaagtaggactgaattctactattgctaggtgtg
4741 agaaagtggtggtgagaaccttagagcagtggagatttgctacctggtctgtgttttgag
4801 aagtgccccttagaaagttaaaagaatgtagaaaagatactcagtcttaatcctatgcaa
4861 aaaaaaaaatcaagtaattgttttcctatgaggaaaataaccatgagctgtatcatgcta
4921 cttagcttttatgtaaatatttcttatgtctcctctattaagagtatttaaaatcatatt
4981 taaatatgaatctattcatgctaacattattttttcaaaacatacatggaaatttagccca
5041 gattgtctacatataaggttttttatttgaattgtaaaatatttaaaagtatgaataaaat
```

Figure 2AI-4

```
5101  atatttataggtatttatcagagatgattattttgtgctacatacaggttggctaatgag
5161  ctctagtgttaaactacctgattaatttcttataaagcagcataaccttggcttgattaa
5221  ggaattctactttcaaaaattaatctgataatagtaacaaggtatattatactttcatta
5281  caatcaaattatagaaattacttgtgtaaaagggcttcaagaatatatccaattttaaa
5341  tattttaatatatctcctatctgataacttaattcttctaaattaccacttgccattaag
5401  ctatttcataataaattctgtacagtttcccccaaaaaaagagatttatttatgaaatat
5461  ttaaagtttctaatgtggtattttaaataaagtatcataaatgtaataagtaaatattta
5521  tttaggaatactgtgaacactgaactaattattcctgtgtcagtctatgaaatccctgtt
5581  ttgaaatacgtaaacagcctaaaatgtgttgaaattattttgtaaatccatgacttaaaa
5641  caagatacatacatagtataacacacctcacagtgttaagatttatattgtgaaatgaga
5701  caccctaccttcaattgttcatcagtgggtaaaacaaattctgatgtacattcaggacaa
5761  atgattagccctaaatgaaactgtaataatttcagtggaaactcaatctgttttaccttt
5821  taaacagtgaattttacatgaatgaatgggttcttcactttttttttagtatgagaaaat
5881  tatacagtgcttaattttcagagattcttccatatgttactaaaaaatgttttgttcag
5941  cctaacatactgagtttttttaactttctaaattattgaattccatcatgcattcatc
6001  caaaattaaggcagactgtttggattcttccagtggccagatgagctaaattaaatcaca
6061  aaagcagatgcttttgtatgatctccaaattgccaactttaaggaaatattctcttgaaa
6121  ttgtctttaaagatcttttgcagctttgcagatacccagactgagctggaactggaattt
6181  gtcttcctattgactctacttcttaaaagcggctgcccattacattcctcagctgtcct
6241  tgcagttaggtgtacatgtgactgagtgttggccagtgagatgaagtctcctcaaaggaa
6301  ggcagcatgtgtcctttttcatcccttcatcttgctgctgggattgtggatataacagga
6361  gccctggcagctgtctccagaggatcaaagccacacccaaagagtaaggcagattagaga
6421  ccagaaagaccttgactacttccctacttccactgcttttcctgcatttaagccattgt
6481  aaatctgggtgtgttacatgaagtgaaattaattctttctgcccttcagttctttatcc
6541  tgataccatttaacactgtctgaattaactagactgcaataattctttcttttgaaagct
6601  tttaaaggataatgtgcaattcacattaaaattgattttccattgtcaattagttatact
6661  cattttcctgccttgatctttcattagatattttgtatctgcttggaatatattatcttc
6721  tttttaactgtgtaattggtaattactaaaactctgtaatctccaaaatattgctatcaa
6781  attacacaccatgttttctatcattctcatagatctgccttataaacatttaataaaaa
6841  gtactatttaatgattt
```

Figure 2AJ-1

The cDNA (SEQ ID. NO.: 72) and amino acid sequence (SEQ ID. NO.: 73) of 98P4B6 v.36. The start methionine is underlined. The open reading frame extends from nucleic acid 394-1866 including the stop codon.

```
   1 gcccctccgagctccccgactcctccccgcgctccacggctcttcccgactccagtcag
  61 cgttcctcgggccctcggcgccacaagctgtccgggcacgcagcccctagcggcgcgtcg
 121 ctgccaagccggcctccgcgcgcctcctccttcttctccctggctgttcgcgatcca
 181 gcttgggtaggcggggaagcagctggagtgcgaccgccacggcagccaccctgcaaccgc
 241 cagtcggaggtgcagtccgtaggccctggccccgggtgggcccttggggagtcggcgcc
 301 gctcccgaggagctgcaaggctcgccctgcccggcgtggagggcgcggggggcgcggag
   1                                              M   E   S   I   S   M   M   G   S
 361 gatattcttggtgatcttggaagtgtccgtatcATGGAATCAATCTCTATGATGGGAAGC
  10 P   K   S   L   S   E   T   C   L   P   N   G   I   N   G   I   K   D   A   R
 421 CCTAAGAGCCTTAGTGAAACTTGTTTACCTAATGGCATAAATGGTATCAAAGATGCAAGG
  30 K   V   T   V   G   V   I   G   S   G   D   F   A   K   S   L   T   I   R   L
 481 AAGGTCACTGTAGGTGTGATTGGAAGTGGAGATTTTGCCAAATCCTTGACCATTCGACTT
  50 I   R   C   G   Y   H   V   V   I   G   S   R   N   P   K   F   A   S   E   F
 541 ATTAGATGCGGCTATCATGTGGTCATAGGAAGTAGAAATCCTAAGTTTGCTTCTGAATTT
  70 F   P   H   V   V   D   V   T   H   H   E   D   A   L   T   K   T   N   I   I
 601 TTTCCTCATGTGGTAGATGTCACTCATCATGAAGATGCTCTCACAAAAACAAATATAATA
  90 F   V   A   I   H   R   E   H   Y   T   S   L   W   D   L   R   H   L   L   V
 661 TTTGTTGCTATACACAGAGAACATTATACCTCCCTGTGGGACCTGAGACATCTGCTTGTG
 110 G   K   I   L   I   D   V   S   N   N   M   R   I   N   Q   Y   P   E   S   N
 721 GGTAAAATCCTGATTGATGTGAGCAATAACATGAGGATAAACCAGTACCCAGAATCCAAT
 130 A   E   Y   L   A   S   L   F   P   D   S   L   I   V   K   G   F   N   V   V
 781 GCTGAATATTTGGCTTCATTATTCCCAGATTCTTTGATTGTCAAAGGATTTAATGTTGTC
 150 S   W   A   L   Q   L   G   P   K   D   A   S   R   Q   V   Y   I   C   S
 841 TCAGCTTGGGCACTTCAGTTAGGACCTAAGGATGCCAGCCGGCAGGTTTATATATGCAGC
 170 N   N   I   Q   A   R   Q   Q   V   I   E   L   A   R   Q   L   N   F   I   P
 901 AACAATATTCAAGCGCGACAACAGGTTATTGAACTTGCCCGCCAGTTGAATTTCATTCCC
 190 I   D   L   G   S   L   S   S   A   R   E   I   E   N   L   P   L   R   L   F
 961 ATTGACTTGGGATCCTTATCATCAGCCAGAGAGATTGAAAATTTACCCCTACGACTCTTT
 210 T   L   W   R   G   P   V   V   V   A   I   S   L   A   T   F   F   F   L   Y
1021 ACTCTCTGGAGAGGGCCAGTGGTGGTAGCTATAAGCTTGGCCACATTTTTTTTCCTTTAT
 230 S   F   V   R   D   V   I   H   P   Y   A   R   N   Q   Q   S   D   F   Y   K
1081 TCCTTTGTCAGAGATGTGATTCATCCATATGCTAGAAACCAACAGAGTGACTTTTACAAA
 250 I   P   I   E   I   V   N   K   T   L   P   I   V   A   I   T   L   L   S   L
1141 ATTCCTATAGAGATTGTGAATAAAACCTTACCTATAGTTGCCATTACTTTGCTCTCCCTA
 270 V   Y   L   A   G   L   L   A   A   Y   Q   L   Y   Y   G   T   K   Y   R
```

Figure 2AJ-2

```
1201 GTATACCTTGCAGGTCTTCTGGCAGCTGCTTATCAACTTTATTACGGCACCAAGTATAGG
 290   R  F  P  P  W  L  E  T  W  L  Q  C  R  K  Q  L  G  L  L  S
1261 AGATTTCCACCTTGGTTGGAAACCTGGTTACAGTGTAGAAAACAGCTTGGATTACTAAGT
 310   F  F  F  A  M  V  H  V  A  Y  S  L  C  L  P  M  R  R  S  E
1321 TTTTTCTTCGCTATGGTCCATGTTGCCTACAGCCTCTGCTTACCGATGAGAAGGTCAGAG
 330   R  Y  L  F  L  N  M  A  Y  Q  Q  V  H  A  N  I  E  N  S  W
1381 AGATATTTGTTTCTCAACATGGCTTATCAGCAGGTTCATGCAAATATTGAAAACTCTTGG
 350   N  E  E  E  V  W  R  I  E  M  Y  I  S  F  G  I  M  S  L  G
1441 AATGAGGAAGAAGTTTGGAGAATTGAAATGTATATCTCCTTTGGCATAATGAGCCTTGGC
 370   L  L  S  L  L  A  V  T  S  I  P  S  V  S  N  A  L  N  W  R
1501 TTACTTTCCCTCCTGGCAGTCACTTCTATCCCTTCAGTGAGCAATGCTTTAAACTGGAGA
 390   E  F  S  F  I  Q  S  T  L  G  Y  V  A  L  L  I  S  T  F  H
1561 GAATTCAGTTTTATTCAGTCTACACTTGGATATGTCGCTCTGCTCATAAGTACTTTCCAT
 410   V  L  I  Y  G  W  K  R  A  F  E  E  E  Y  Y  R  F  Y  T  P
1621 GTTTTAATTTATGGATGGAAACGAGCTTTTGAGGAAGAGTACTACAGATTTTATACACCA
 430   P  N  F  V  L  A  L  V  L  P  S  I  V  I  L  G  K  I  I  L
1681 CCAAACTTTGTTCTTGCTCTTGTTTTGCCCTCAATTGTAATTCTGGGTAAGATTATTTTA
 450   F  L  P  C  I  S  R  K  L  K  R  I  K  K  G  W  E  K  S  Q
1741 TTCCTTCCATGTATAAGCCGAAAGCTAAAACGAATTAAAAAAGGCTGGGAAAAGAGCCAA
 470   F  L  E  E  G  M  G  G  T  I  P  H  V  S  P  E  R  V  T  V
1801 TTTCTGGAAGAAGGTATGGGAGGAACAATTCCTCATGTCTCCCCGGAGAGGGTCACAGTA
 490   M  *
1861 ATGTGAtgacaaatggtgttcacagctgccatataaagttctactcatgccattatttt
1921 atgacttctacgttcagttacaagtatgctgtcaaattatcgtgggttgaaacttgttaa
1981 atgagatttcaactgacttagtgatagagttttcttcaagttaattttcacaaatgtcat
2041 gtttgccaatatgaattttctagtcaacatattattgtaatttaggtatgttttgtttt
2101 gttttgcacaactgtaaccctgttgttactttatatttcataatcaggcaaaaatactta
2161 cagttaataatatagatataatgttaaaaacaatttgcaaaccagcagaattttaagctt
2221 ttaaaataattcaatggatatacattttttctgaagattaagattttaattattcaact
2281 taaaaagtagaaatgcattattatacattttttaagaaaggacacgttatgttagcatc
2341 taggtaaggctgcatgatagcattcctatatttctctcataaaataggatttgaaggatg
2401 aaattaattgtatgaagcaatgtgattatatgaagagacacaaattaaaaagacaaatta
2461 aacctgaaattatatttaaaatatatttgagacatgaaatacatactgataatacatacc
2521 tcatgaaagattttattctttattgtgttacagagcagtttcattttcatattaatatac
2581 tgatcaggaagaggattcagtaacatttggcttccaaaactgctatctctaatacggtac
2641 caatcctaggaactgtatactagttcctacttagaacaaaagtatcaagtttgcacacaa
2701 gtaatctgccagctgacctttgtcgcaccttaaccagtcaccacttgctatggtatagga
2761 ttatactgatgttctttgagggattctgatgtgctaggcatggttctaagtactttactt
```

Figure 2AJ-3

```
2821 gtattatcccatttaatacttagaacaaccccgtgagataagtagttattatcctcattt
2881 tacacatgagggaccgaaggatagaaaagttattttcaaaggtcttgcagttaataaat
2941 ggcagagtgagcattcaagtccaggtagtcatattccagaggccacggttttaaccacta
3001 ggctctagagctcccgccgcgcccctatgcattatgttcacaatgccaatctagatgctt
3061 cctcttttgtataaagtcactgacattctttagagtgggttgggtgcatccaaaaatgta
3121 taaaaatattattataataaacttattactgcttgtagggtaattcacagttacttaccc
3181 tattcttgcttggaacatgagcctggagacccatggcagtccatatgcctccctatgcag
3241 tgaagggccctagcagtgttaacaaattgctgagatcccacggagtctttcaaaaatctc
3301 tgtagagttagtcttctccttttctcttcctgagaagttctcctgcctgcataaccattc
3361 attagggagtactttacaagcatgaaggatattagggtaagtggctaattataaatctac
3421 tctagagacatataatcatacagattattcataaaattttcagtgctgtccttccacat
3481 ttaattgcattttgctcaaactgtagaatgccctacattcccccaccccaatttgctat
3541 ttccttattaaaatagaaaattataggcaagatacaattatatgcgttcctcttcctgaa
3601 attataacatttctaaacttacccacgtaggtactactgaatccaactgccaacaataaa
3661 aagactttatttagtagaggctacctttcccaccagtgactcttttctacaactgcct
3721 tgtcagtttggtaattcacttatgattttctaatgttctcttggtgaattttattatctt
3781 gtaccctcttttttttttttttttttaaagacagagtcttgctctgtcacccaggct
3841 ggagtgcagtggcacgatctcggctcactgcaagctctgcctcccgggttcacgccattc
3901 tcctgcctcagcctcccgagtagctgggactacaggtgcccgccaccatgcccggctgat
3961 ttcttttgtatttttagtagagacggagtttcaccgtgttagccaggatggtctcgatc
4021 tcctgacctcgtgatccgcccgccttggcctccaaagtgctgggattacaggtgtgagct
4081 accgcgcccggcctattatcttgtactttctaactgagccctctattttctttatttaa
4141 taatatttctccccacttgagaatcacttgttagttcttggtaggaattcagttgggcaa
4201 tgataacttttatgggcaaaaacattctattatagtgaactaatgaaaataacagcgtat
4261 tttcaatattttcttattccttaaattccactcttttaacactatgcttaaccacttaat
4321 gtgatgaaatattcctaaaagttaaatgactattaaagcatatattgttgcatgtatata
4381 ttaagtagccgatactctaaataaaaataccactgttacagataaatggggcctttaaaa
4441 atatgaaaaacaaacttgtgaaaatgtataaaagatgcatctgttgtttcaaatggcact
4501 atcttcttttcagtactacaaaaacagaataattttgaagttttagaataaatgtaatat
4561 atttactataattctaaatgtttaaatgcttttctaaaaatgcaaaactatgatgtttag
4621 ttgctttatttacctctatgtgattattttcttaattgttatttttataatcattat
4681 ttttctgaaccattcttctggcctcagaagtaggactgaattctactattgctaggtgtg
4741 agaaagtggtggtgagaaccttagagcagtggagatttgctacctggtctgtgttttgag
4801 aagtgccccttagaaagttaaaagaatgtagaaaagatactcagtcttaatcctatgcaa
4861 aaaaaaaatcaagtaattgttttcctatgaggaaaataaccatgagctgtatcatgcta
4921 cttagcttttatgtaaatatttcttatgtctcctctattaagagtatttaaaatcatatt
4981 taaatatgaatctattcatgctaacattattttcaaaacatacatggaaatttagccca
5041 gattgtctacatataaggttttatttgaattgtaaaatatttaaaagtatgaataaaat
```

Figure 2AJ-4

```
5101  atatttataggtatttatcagagatgattattttgtgctacatacaggttggctaatgag
5161  ctctagtgttaaactacctgattaatttcttataaagcagcataaccttggcttgattaa
5221  ggaattctactttcaaaaattaatctgataatagtaacaaggtatattatactttcatta
5281  caatcaaattatagaaattacttgtgtaaaagggcttcaagaatatatccaattttttaaa
5341  tattttaatatatctcctatctgataacttaattcttctaaattaccacttgccattaag
5401  ctatttcataataaattctgtacagtttccccgaaaaaagagatttatttatgaaatat
5461  ttaaagtttctaatgtggtattttaaataaagtatcataaatgtaataagtaaatattta
5521  tttaggaatactgtgaacactgaactaattattcctgtgtcagtctatgaaatccctgtt
5581  ttgaaatacgtaaacagcctaaaatgtgttgaaattattttgtaaatccatgacttaaaa
5641  caagatacatacatagtataacacacctcacagtgttaagatttatattgtgaaatgaga
5701  cacctaccttcaattgttcatcagtgggtaaaacaaattctgatgtacattcaggacaa
5761  atgattagccctaaatgaaactgtaataatttcagtggaaactcaatctgttttaccttt
5821  taaacagtgaattttacatgaatgaatgggttcttcacttttttttagtatgagaaaat
5881  tatacagtgcttaattttcagagattctttccatatgttactaaaaatgttttgttcag
5941  cctaacatactgagttttttttaactttctaaattattgaatttccatcatgcattcatc
6001  caaaattaaggcagactgtttggattcttccagtggccagatgagctaaattaaatcaca
6061  aaagcagatgcttttgtatgatctccaaattgccaactttaaggaaatattctcttgaaa
6121  ttgtctttaaagatcttttgcagctttgcagatacccagactgagctggaactggaattt
6181  gtcttcctattgactctacttctttaaaagcggctgcccattacattcctcagctgtcct
6241  tgcagttaggtgtacatgtgactgagtgttggccagtgagatgaagtctcctcaaaggaa
6301  ggcagcatgtgtcctttttcatcccttcatcttgctgctgggattgtggatataacagga
6361  gccctggcagctgtctccagaggatcaaagccacacccaaagagtaaggcagattagaga
6421  ccagaaagaccttgactacttccctacttccactgcttttcctgcatttaagccattgt
6481  aaatctgggtgtgttacatgaagtgaaaattaattctttctgcccttcagttctttatcc
6541  tgataccatttaacactgtctgaattaactagactgcaataattctttcttttgaaagct
6601  tttaaaggataatgtgcaattcacattaaaattgattttccattgtcaattagttatact
6661  cattttcctgccttgatctttcattagatattttgtatctgcttggaatatattatcttc
6721  tttttaactgtgtaattggtaattactaaaactctgtaatctccaaaatattgctatcaa
6781  attacacaccatgttttctatcattctcatagatctgccttataaacatttaaataaaaa
6841  gtactatttaatgattt
```

Figure 2AK-1

The cDNA (SEQ ID. NO.: 74) and amino acid sequence (SEQ ID. NO.: 75) of 98P4B6 v.37. The start methionine is underlined. The open reading frame extends from nucleic acid 394-1866 including the stop codon.

```
   1 gccccctccgagctccccgactcctccccgcgctccacggctcttcccgactccagtcag
  61 cgttcctcgggccctcggcgccacaagctgtccgggcacgcagcccctagcggcgcgtcg
 121 ctgccaagccggcctccgcgcgcctccctccttccttctccctggctgttcgcgatcca
 181 gcttgggtaggcggggaagcagctggagtgcgaccgccacggcagccaccctgcaaccgc
 241 cagtcggaggtgcagtccgtaggccctggccccgggtgggcccttggggagtcggcgcc
 301 gctcccgaggagctgcaaggctcgccctgcccggcgtggagggcgcggggggcgcggag
   1                                              M  E  S  I  S  M  M  G  S
 361 gatattcttggtgatcttggaagtgtccgtatcATGGAATCAATCTCTATGATGGGAAGC
  10 P  K  S  L  S  E  T  C  L  P  N  G  I  N  G  I  K  D  A  R
 421 CCTAAGAGCCTTAGTGAAACTTGTTTACCTAATGGCATAAATGGTATCAAAGATGCAAGG
  30 K  V  T  V  G  V  I  G  S  G  D  F  A  K  S  L  T  I  R  L
 481 AAGGTCACTGTAGGTGTGATTGGAAGTGGAGATTTTGCCAAATCCTTGACCATTCGACTT
  50 I  R  C  G  Y  H  V  V  I  G  S  R  N  P  K  F  A  S  E  F
 541 ATTAGATGCGGCTATCATGTGGTCATAGGAAGTAGAAATCCTAAGTTTGCTTCTGAATTT
  70 F  P  H  V  V  D  V  T  H  H  E  D  A  L  K  T  N  I  I
 601 TTTCCTCATGTGGTAGATGTCACTCATCATGAAGATGCTCTCACAAAAACAAATATAATA
  90 F  V  A  I  H  R  E  H  Y  T  S  L  W  D  L  R  H  L  L  V
 661 TTTGTTGCTATACACAGAGAACATTATACCTCCCTGTGGGACCTGAGACATCTGCTTGTG
 110 G  K  I  L  I  D  V  S  N  N  M  R  I  N  Q  Y  P  E  S  N
 721 GGTAAAATCCTGATTGATGTGAGCAATAACATGAGGATAAACCAGTACCCAGAATCCAAT
 130 A  E  Y  L  A  S  L  F  P  D  S  L  I  V  K  G  F  N  V  V
 781 GCTGAATATTTGGCTTCATTATTCCCAGATTCTTTGATTGTCAAAGGATTTAATGTTGTC
 150 S  A  W  A  L  Q  L  G  P  K  D  A  S  R  Q  V  Y  I  C  S
 841 TCAGCTTGGGCACTTCAGTTAGGACCTAAGGATGCCAGCCGGCAGGTTTATATATGCAGC
 170 N  N  I  Q  A  R  Q  Q  V  I  E  L  A  R  Q  L  N  F  I  P
 901 AACAATATTCAAGCGCGACAACAGGTTATTGAACTTGCCCGCCAGTTGAATTTCATTCCC
 190 I  D  L  G  S  L  S  S  A  R  E  I  E  N  L  P  L  R  L  F
 961 ATTGACTTGGGATCCTTATCATCAGCCAGAGAGATTGAAAATTTACCCCTACGACTCTTT
 210 T  L  W  R  G  P  V  V  V  A  I  S  L  A  T  F  F  L  Y
1021 ACTCTCTGGAGAGGGCCAGTGGTGGTAGCTATAAGCTTGGCCACATTTTTTTTCCTTTAT
 230 S  F  V  R  D  V  I  H  P  Y  A  R  N  Q  Q  S  D  F  Y  K
1081 TCCTTTGTCAGAGATGTGATTCATCCATATGCTAGAAACCAACAGAGTGACTTTTACAAA
 250 I  P  I  E  I  V  N  K  T  L  P  I  V  A  I  T  L  L  S  L
1141 ATTCCTATAGAGATTGTGAATAAAACCTTACCTATAGTTGCCATTACTTTGCTCTCCCTA
 270 V  Y  L  A  G  L  L  A  A  A  Y  Q  L  Y  Y  G  T  K  Y  R
```

Figure 2AK-2

```
1201 GTATACCTTGCAGGTCTTCTGGCAGCTGCTTATCAACTTTATTACGGCACCAAGTATAGG
 290  R  F  P  P  W  L  E  T  W  L  Q  C  R  K  Q  L  G  L  L  S
1261 AGATTTCCACCTTGGTTGGAAACCTGGTTACAGTGTAGAAAACAGCTTGGATTACTAAGT
 310  F  F  F  A  M  V  H  V  A  Y  S  L  C  L  P  M  R  R  S  E
1321 TTTTTCTTCGCTATGGTCCATGTTGCCTACAGCCTCTGCTTACCGATGAGAAGGTCAGAG
 330  R  Y  L  F  L  N  M  A  Y  Q  Q  V  H  A  N  I  E  N  S  W
1381 AGATATTTGTTTCTCAACATGGCTTATCAGCAGGTTCATGCAAATATTGAAAACTCTTGG
 350  N  E  E  V  W  R  I  E  M  Y  I  S  F  G  I  M  S  L  G
1441 AATGAGGAAGAAGTTTGGAGAATTGAAATGTATATCTCCTTTGGCATAATGAGCCTTGGC
 370  L  L  S  L  L  A  V  T  S  I  P  S  V  S  N  A  L  N  W  R
1501 TTACTTTCCCTCCTGGCAGTCACTTCTATCCCTTCAGTGAGCAATGCTTTAAACTGGAGA
 390  E  F  S  F  I  Q  S  T  L  G  Y  V  A  L  L  I  S  T  F  H
1561 GAATTCAGTTTTATTCAGTCTACACTTGGATATGTCGCTCTGCTCATAAGTACTTTCCAT
 410  V  L  I  Y  G  W  K  R  A  F  E  E  E  Y  Y  R  F  Y  T  P
1621 GTTTTAATTTATGGATGGAAACGAGCTTTTGAGGAAGAGTACTACAGATTTTATACACCA
 430  P  N  F  V  L  A  L  V  L  P  S  I  V  I  L  G  K  I  I  L
1681 CCAAACTTTGTTCTTGCTCTTGTTTTGCCCTCAATTGTAATTCTGGGTAAGATTATTTTA
 450  F  L  P  C  I  S  R  K  L  K  R  I  K  K  G  W  E  K  S  Q
1741 TTCCTTCCATGTATAAGCCGAAAGCTAAAACGAATTAAAAAAGGCTGGGAAAAGAGCCAA
 470  F  L  E  E  G  M  G  G  T  I  P  H  V  S  P  E  R  V  T  V
1801 TTTCTGGAAGAAGGTATGGGAGGAACAATTCCTCATGTCTCCCCGGAGAGGGTCACAGTA
 490  M  *
1861 ATGTGAtgacaaatggtgttcacagctgccatataaagttctactcatgccattattttt
1921 atgacttctacgttcagttacaagtatgctgtcaaattatcgtgggttgaaacttgttaa
1981 atgagatttcaactgacttagtgatagagttttcttcaagttaattttcacaaatgtcat
2041 gtttgccaatatgaattttctagtcaacatattattgtaatttaggtatgttttgtttt
2101 gttttgcacaactgtaaccctgttgttactttatatttcataatcaggcaaaaatactta
2161 cagttaataatatagatataatgttaaaaacaatttgcaaaccagcagaattttaagctt
2221 ttaaaataattcaatggatatacattttttctgaagattaagattttaattattcaact
2281 taaaaagtagaaatgcattattatacatttttttaagaaaggacacgttatgttagcatc
2341 taggtaaggctgcatgatagcattcctatatttctctcataaaataggatttgaaggatg
2401 aaattaattgtatgaagcaatgtgattatatgaagagacacaaattaaaaagacaaatta
2461 aacctgaaattatatttaaaatatatttgagacatgaaatacatactgataatacatacc
2521 tcatgaaagattttattctttattgtgttacagagcagtttcattttcatattaatatac
2581 tgatcaggaagaggattcagtaacatttggcttccaaaactgctatctctaatacggtac
2641 caatcctaggaactgtatactagttcctacttagaacaaaagtatcaagtttgcacacaa
2701 gtaatctgccagctgacctttgtcgcaccttaaccagtcaccacttgctatggtatagga
2761 ttatactgatgttctttgagggattctgatgtgctaggcatggttctaagtactttactt
```

Figure 2AK-3

```
2821 gtattatcccatttaatacttagaacaacccgtgagataagtagttattatcctcattt
2881 tacacatgagggaccgaaggatagaaaagttattttcaaaggtcttgcagttaataaat
2941 ggcagagtgagcattcaagtccaggtagtcatattccagaggccacggttttaaccacta
3001 ggctctagagctcccgccgcgcccctatgcattatgttcacaatgccaatctagatgctt
3061 cctcttttgtataaagtcactgacattctttagagtgggttgggtgcatccaaaaatgta
3121 taaaaatattattataataaacttattactgcttgtagggtaattcacagttacttaccc
3181 tattcttgcttggaacatgagcctggagacccatggcagtccatatgcctccctatgcag
3241 tgaagggccctagcagtgttaacaaattgctgagatcccacggagtctttcaaaaatctc
3301 tgtagagttagtcttctccttttctcttcctgagaagttctcctgcctgcataaccattc
3361 attagggagtactttacaagcatgaaggatattagggtaagtggctaattataaatctac
3421 tctagagacatataatcatacagattattcataaattttcagtgctgtccttccacat
3481 ttaattgcattttgctcaaactgtagaatgccctacattccccccaccccaatttgctat
3541 ttccttattaaaatagaaaattataggcaagatacaattatatgcgttcctcttcctgaa
3601 attataacatttctaaacttacccacgtaggtactactgaatccaactgccaacaataaa
3661 aagacttttatttagtagaggctacctttcccaccagtgactcttttctacaactgcct
3721 tgtcagtttggtaattcacttatgattttctaatgttctcttggtgaattttattatctt
3781 gtaccctcttttttttttttttttttttaaagacagagtcttgctctgtcacccaggct
3841 ggagtgcagtggcacgatctcggctcactgcaagctctgcctcccgggttcacgccattc
3901 tcctgcctcagcctcccgagtagctgggactacaggtgcccgccaccatgcccggctgat
3961 ttcttttgtatttttagtagagacggagttcaccgtgttagccaggatggtctcgatc
4021 tcctgacctcgtgatccgcccgccttggcctccaaagtgctgggattacaggtgtgagct
4081 accgcgcccggcctattatcttgtactttctaactgagccctctattttctttattttaa
4141 taatatttctccccacttgagaatcacttgttagttcttggtaggaattcagttgggcaa
4201 tgataacttttatgggcaaaaacattctattatagtgaactaatgaaaataacagcgtat
4261 tttcaatattttcttattccttaaattccactcttttaacactatgcttaaccacttaat
4321 gtgatgaaatattcctaaaagttaaatgactattaaagcatatattgttgcatgtatata
4381 ttaagtagccgatactctaaataaaaataccactgttacagataaatggggcctttaaaa
4441 atatgaaaaacaaacttgtgaaaatgtataaaagatgcatctgttgtttcaaatggcact
4501 atcttcttttcagtactacaaaaacagaataattttgaagttttagaataaatgtaatat
4561 atttactataattctaaatgtttaaatgcttttctaaaaatgcaaaactatgatgtttag
4621 ttgctttatttacctctatgtgattattttcttaattgttatttttataatcattat
4681 ttttctgaaccattcttctggcctcagaagtaggactgaattctactattgctaggtgtg
4741 agaaagtggtggtgagaaccttagagcagtggagatttgctacctggtctgtgttttgag
4801 aagtgccccttagaaagttaaaagaatgtagaaaagatactcagtcttaatcctatgcaa
4861 aaaaaaaatcaagtaattgttttcctatgaggaaaataaccatgagctgtatcatgcta
4921 cttagcttttatgtaaatatttcttatgtctcctctattaagagtatttaaaatcatatt
4981 taaatatgaatctattcatgctaacattattttttcaaaacatacatggaaatttagccca
5041 gattgtctacatataaggttttatttgaattgtaaaatatttaaaagtatgaataaaat
```

Figure 2AK-4

```
5101 atatttataggtatttatcagagatgattattttgtgctacatacaggttggctaatgag
5161 ctctagtgttaaactacctgattaatttcttataaagcagcataaccttggcttgattaa
5221 ggaattctactttcaaaaattaatctgataatagtaacaaggtatattatactttcatta
5281 caatcaaattatagaaattacttgtgtaaaagggcttcaagaatatatccaattttaaa
5341 tattttaatatatctcctatctgataacttaattcttctaaattaccacttgccattaag
5401 ctatttcataataaattctgtacagtttccccctaaaaagagatttatttatgaaatat
5461 ttaaagtttctaatgtggtattttaaataaagtatcataaatgtaataagtaaatattta
5521 tttaggaatactgtgaacactgaactaattattcctgtgtcagtctatgaaatccctgtt
5581 ttgaaatacgtaaacagcctaaaatgtgttgaattattttgtaaatccatgacttaaaa
5641 caagatacatacatagtataacacacctcacagtgttaagatttatattgtgaaatgaga
5701 caccctaccttcaattgttcatcagtgggtaaaacaaattctgatgtacattcaggacaa
5761 atgattagccctaaatgaaactgtaataatttcagtggaaactcaatctgttttacctt
5821 taaacagtgaattttacatgaatgaatgggttcttcactttttttttagtatgagaaaat
5881 tatacagtgcttaattttcagagattctttccatatgttactaaaaaatgttttgttcag
5941 cctaacatactgagttttttttaactttctaaattattgaatttccatcatgcattcatc
6001 caaaattaaggcagactgtttggattcttccagtggccagatgagctaaattaaatcaca
6061 aaagcagatgcttttgtatgatctccaaattgccaactttaaggaaatattctcttgaaa
6121 ttgtcttaaagatcttttgcagctttgcagatacccagactgagctggaactggaattt
6181 gtcttcctattgactctacttctttaaaagcggctgcccattacattcctcagctgtcct
6241 tgcagttaggtgtacatgtgactgagtgttggccagtgagatgaagtctcctcaaaggaa
6301 ggcagcatgtgtccttttcatcccttcatcttgctgctgggattgtggatataacagga
6361 gccctggcagctgtctccagaggatcaaagccacacccaaagagtaaggcagattagaga
6421 ccagaaagaccttgactacttccctacttccactgcttttcctgcatttaagccattgt
6481 aaatctgggtgtgttacatgaagtgaaaattaattctttctgcccttcagttctttatcc
6541 tgataccatttaacactgtctgaattaactagactgcaataattctttcttttgaaagct
6601 tttaaaggataatgtgcaattcacattaaaattgattttccattgtcaattagttatact
6661 catttcctgccttgatctttcattagatattttgtatctgcttggaatatattatcttc
6721 tttttaactgtgtaattggtaattactaaaactctgtaatctccaaaatattgctatcaa
6781 attacacaccatgttttctatcattctcatagatctgccttataaacatttaaataaaaa
6841 gtactatttaatgattt
```

Figure 2AL-1

The cDNA (SEQ ID. NO. : 76) and amino acid sequence (SEQ ID. NO. : 77) of 98P4B6 v.38. The start methionine is underlined. The open reading frame extends from nucleic acid 394-1866 including the stop codon.

```
   1 gcccctccgagctccccgactcctccccgcgctccacggctcttcccgactccagtcag
  61 cgttcctcgggccctcggcgccacaagctgtccgggcacgcagccctagcggcgcgtcg
 121 ctgccaagccggcctccgcgcgcctcctccttccttctccctggctgttcgcgatcca
 181 gcttgggtaggcggggaagcagctggagtgcgaccgccacggcagccaccctgcaaccgc
 241 cagtcggaggtgcagtccgtaggccctggccccgggtgggcccttggggagtcggcgcc
 301 gctcccgaggagctgcaaggctcgcccctgccggcgtggagggcgcgggggggcgcggag
   1                                         M   E   S   I   S   M   M   G   S
 361 gatattcttggtgatcttggaagtgtccgtatcATGGAATCAATCTCTATGATGGGAAGC
  10  P   K   S   L   S   E   T   C   L   P   N   G   I   N   G   I   K   D   A   R
 421 CCTAAGAGCCTTAGTGAAACTTGTTTACCTAATGGCATAAATGGTATCAAAGATGCAAGG
  30  K   V   T   V   G   V   I   G   S   G   D   F   A   K   S   L   T   I   R   L
 481 AAGGTCACTGTAGGTGTGATTGGAAGTGGAGATTTTGCCAAATCCTTGACCATTCGACTT
  50  I   R   C   G   Y   H   V   V   I   G   S   R   N   P   K   F   A   S   E   F
 541 ATTAGATGCGGCTATCATGTGGTCATAGGAAGTAGAAATCCTAAGTTTGCTTCTGAATTT
  70  F   P   H   V   V   D   V   T   H   H   E   D   A   L   T   K   T   N   I   I
 601 TTTCCTCATGTGGTAGATGTCACTCATCATGAAGATGCTCTCACAAAAACAAATATAATA
  90  F   V   A   I   H   R   E   H   Y   T   S   L   W   D   L   R   H   L   L   V
 661 TTTGTTGCTATACACAGAGAACATTATACCTCCCTGTGGGACCTGAGACATCTGCTTGTG
 110  G   K   I   L   I   D   V   S   N   N   M   R   I   N   Q   Y   P   E   S   N
 721 GGTAAAATCCTGATTGATGTGAGCAATAACATGAGGATAAACCAGTACCCAGAATCCAAT
 130  A   E   Y   L   A   S   L   F   P   D   S   L   I   V   K   G   F   N   V   V
 781 GCTGAATATTTGGCTTCATTATTCCCAGATTCTTTGATTGTCAAAGGATTTAATGTTGTC
 150  S   A   W   A   L   Q   L   G   P   K   D   A   S   R   Q   V   Y   I   C   S
 841 TCAGCTTGGGCACTTCAGTTAGGACCTAAGGATGCCAGCCGGCAGGTTTATATATGCAGC
 170  N   N   I   Q   A   R   Q   Q   V   I   E   L   A   R   Q   L   N   F   I   P
 901 AACAATATTCAAGCGCGACAACAGGTTATTGAACTTGCCCGCCAGTTGAATTTCATTCCC
 190  I   D   L   G   S   L   S   S   A   R   E   I   E   N   L   P   L   R   L   F
 961 ATTGACTTGGGATCCTTATCATCAGCCAGAGAGATTGAAAATTTACCCCTACGACTCTTT
 210  T   L   W   R   G   P   V   V   V   A   I   S   L   A   T   F   F   L   Y
1021 ACTCTCTGGAGAGGGCCAGTGGTGGTAGCTATAAGCTTGGCCACATTTTTTTTCCTTTAT
 230  S   F   V   R   D   V   I   H   P   Y   A   R   N   Q   Q   S   D   F   Y   K
1081 TCCTTTGTCAGAGATGTGATTCATCCATATGCTAGAAACCAACAGAGTGACTTTTACAAA
 250  I   P   I   E   I   V   N   K   T   L   P   I   V   A   I   T   L   L   S   L
1141 ATTCCTATAGAGATTGTGAATAAAACCTTACCTATAGTTGCCATTACTTTGCTCTCCCTA
 270  V   Y   L   A   G   L   L   A   A   A   Y   Q   L   Y   Y   G   T   K   Y   R
```

Figure 2AL-2

```
1201 GTATACCTTGCAGGTCTTCTGGCAGCTGCTTATCAACTTTATTACGGCACCAAGTATAGG
 290   R  F  P  P  W  L  E  T  W  L  Q  C  R  K  Q  L  G  L  L  S
1261 AGATTTCCACCTTGGTTGGAAACCTGGTTACAGTGTAGAAAACAGCTTGGATTACTAAGT
 310   F  F  F  A  M  V  H  V  A  Y  S  L  C  L  P  M  R  R  S  E
1321 TTTTTCTTCGCTATGGTCCATGTTGCCTACAGCCTCTGCTTACCGATGAGAAGGTCAGAG
 330   R  Y  L  F  L  N  M  A  Y  Q  Q  V  H  A  N  I  E  N  S  W
1381 AGATATTTGTTTCTCAACATGGCTTATCAGCAGGTTCATGCAAATATTGAAAACTCTTGG
 350   N  E  E  V  W  R  I  E  M  Y  I  S  F  G  I  M  S  L  G
1441 AATGAGGAAGAAGTTTGGAGAATTGAAATGTATATCTCCTTTGGCATAATGAGCCTTGGC
 370   L  L  S  L  L  A  V  T  S  I  P  S  V  S  N  A  L  N  W  R
1501 TTACTTTCCCTCCTGGCAGTCACTTCTATCCCTTCAGTGAGCAATGCTTTAAACTGGAGA
 390   E  F  S  F  I  Q  S  T  L  G  Y  V  A  L  L  I  S  T  F  H
1561 GAATTCAGTTTTATTCAGTCTACACTTGGATATGTCGCTCTGCTCATAAGTACTTTCCAT
 410   V  L  I  Y  G  W  K  R  A  F  E  E  E  Y  Y  R  F  Y  T  P
1621 GTTTTAATTTATGGATGGAAACGAGCTTTTGAGGAAGAGTACTACAGATTTTATACACCA
 430   P  N  F  V  L  A  L  V  L  P  S  I  V  I  L  G  K  I  I  L
1681 CCAAACTTTGTTCTTGCTCTTGTTTTGCCCTCAATTGTAATTCTGGGTAAGATTATTTTA
 450   F  L  P  C  I  S  R  K  L  K  R  I  K  K  G  W  E  K  S  Q
1741 TTCCTTCCATGTATAAGCCGAAAGCTAAAACGAATTAAAAAAGGCTGGGAAAAGAGCCAA
 470   F  L  E  E  G  M  G  G  T  I  P  H  V  S  P  E  R  V  T  V
1801 TTTCTGGAAGAAGGTATGGGAGGAACAATTCCTCATGTCTCCCCGGAGAGGGTCACAGTA
 490   M  *
1861 ATGTGAtgacaaatggtgttcacagctgccatataaagttctactcatgccattattttt
1921 atgacttctacgttcagttacaagtatgctgtcaaattatcgtgggttgaaacttgttaa
1981 atgagatttcaactgacttagtgatagagttttcttcaagttaattttcacaaatgtcat
2041 gtttgccaatatgaattttttctagtcaacatattattgtaatttaggtatgttttgtttt
2101 gttttgcacaactgtaaccctgttgttactttatatttcataatcaggcaaaaatactta
2161 cagttaataatatagatataatgttaaaaacaatttgcaaaccagcagaattttaagctt
2221 ttaaaataattcaatggatatacatttttttctgaagattaagattttaattattcaact
2281 taaaaagtagaaatgcattattatacattttttaagaaaggacacgttatgttagcatc
2341 taggtaaggctgcatgatagcattcctatatttctctcataaaataggatttgaaggatg
2401 aaattaattgtatgaagcaatgtgattatatgaagagacacaaattaaaaagacaaatta
2461 aacctgaaattatatttaaaatatatttgagacatgaaatacatactgataatacatacc
2521 tcatgaaagatttattctttattgtgttacagagcagtttcattttcatattaatatac
2581 tgatcaggaagaggattcagtaacatttggcttccaaaactgctatctctaatacggtac
2641 caatcctaggaactgtatactagttcctacttagaacaaaagtatcaagtttgcacacaa
2701 gtaatctgccagctgacctttgtcgcaccttaaccagtcaccacttgctatggtatagga
2761 ttatactgatgttcttgagggattctgatgtgctaggcatggttctaagtactttactt
```

Figure 2AL-3

```
2821  gtattatcccatttaatacttagaacaaccccgtgagataagtagttattatcctcattt
2881  tacacatgagggaccgaaggatagaaaagttattttttcaaaggtcttgcagttaataaat
2941  ggcagagtgagcattcaagtccaggtagtcatattccagaggccacggttttaaccacta
3001  ggctctagagctcccgccgcgcccctatgcattatgttcacaatgccaatctagatgctt
3061  cctcttttgtataaagtcactgacattctttagagtgggttgggtgcatccaaaaatgta
3121  taaaaatattattataataaacttattactgcttgtagggtaattcacagttacttaccc
3181  tattcttgcttggaacatgagcctggagacccatggcagtccatatgcctccctatgcag
3241  tgaagggccctagcagtgttaacaaattgctgagatcccacggagtctttcaaaaatctc
3301  tgtagagttagtcttctccttttctcttcctgagaagttctcctgcctgcataaccattc
3361  attagggagtactttacaagcatgaaggatattagggtaagtggctaattataaatctac
3421  tctagagacatataatcatacagattattcataaaattttcagtgctgtccttccacat
3481  ttaattgcattttgctcaaactgtagaatgccctacattccccccaccccaatttgctat
3541  ttccttattaaaatagaaaattataggcaagatacaattatatgcgttcctcttcctgaa
3601  attataacatttctaaacttacccacgtaggtactactgaatccaactgccaacaataaa
3661  aagactttatttagtagaggctacctttcccaccagtgactcttttctacaactgcct
3721  tgtcagtttggtaattcacttatgattttctaatgttctcttggtgaatttattatctt
3781  gtaccctcttttttttttttttttttttaaagacagagtcttgctctgtcacccaggct
3841  ggagtgcagtggcacgatctcggctcactgcaagctctgcctcccgggttcacgccattc
3901  tcctgcctcagcctcccgagtagctgggactacaggtgcccgccaccatgcccggctgat
3961  ttctttttgtattttagtagagacggagtttcaccgtgttagccaggatggtctcgatc
4021  tcctgacctcgtgatccgcccgccttggcctccaaagtgctgggattacaggtgtgagct
4081  accgcgcccggcctattatcttgtactttctaactgagccctctattttctttattttaa
4141  taatatttctccccacttgagaatcacttgttagttcttggtaggaattcagttgggcaa
4201  tgataactttatgggcaaaaacattctattatagtgaactaatgaaaataacagcgtat
4261  tttcaatattttcttattccttaaattccactcttttaacactatgcttaaccacttaat
4321  gtgatgaaatattcctaaaagttaaatgactattaaagcatatattgttgcatgtatata
4381  ttaagtagccgatactctaaataaaaataccactgttacagataaatggggcctttaaaa
4441  atatgaaaaacaaacttgtgaaaatgtataaaagatgcatctgttgtttcaaatggcact
4501  atcttcttttcagtactacaaaaacagaataattttgaagttttagaataaatgtaatat
4561  atttactataattctaaatgtttaaatgcttttctaaaaatgcaaaactatgatgtttag
4621  ttgctttattttacctctatgtgattattttcttaattgttattttttataatcattat
4681  ttttctgaaccattcttctggcctcagaagtaggactgaattctactattgctaggtgtg
4741  agaaagtggtggtgagaaccttagagcagtggagatttgctacctggtctgtgttttgag
4801  aagtgccccttagaaagttaaagaatgtagaaaagatactcagtcttaatcctatgcaa
4861  aaaaaaaatcaagtaattgttttcctatgaggaaaataaccatgagctgtatcatgcta
4921  cttagcttttatgtaaatatttcttatgtctcctctattaagagtatttaaaatcatatt
4981  taaatatgaatctattcatgctaacattattttcaaaacatacatggaaatttagccca
5041  gattgtctacatataaggttttttatttgaattgtaaaatatttaaaagtatgaataaaat
```

Figure 2AL-4

```
5101  atatttataggtatttatcagagatgattattttgtgctacatacaggttggctaatgag
5161  ctctagtgttaaactacctgattaatttcttataaagcagcataaccttggcttgattaa
5221  ggaattctactttcaaaaattaatctgataatagtaacaaggtatattatactttcatta
5281  caatcaaattatagaaattacttgtgtaaaagggcttcaagaatatatccaattttaaa
5341  tattttaatatatctcctatctgataacttaattcttctaaattaccacttgccattaag
5401  ctatttcataataaattctgtacagtttccccccaaaaaagagatttatttatgaaatat
5461  ttaaagtttctaatgtggtattttaaataaagtatcataaatgtaataagtaaatattta
5521  tttaggaatactgtgaacactgaactaattattcctgtgtcagtctatgaaatccctgtt
5581  ttgaaataagtaaacagcctaaaatgtgttgaattattttgtaaatccatgacttaaaa
5641  caagatacatacatagtataacacacctcacagtgttaagatttatattgtgaaatgaga
5701  caccctaccttcaattgttcatcagtgggtaaaacaaattctgatgtacattcaggacaa
5761  atgattagccctaaatgaaactgtaataatttcagtggaaactcaatctgttttacctt
5821  taaacagtgaattttacatgaatgaatgggttcttcactttttttttagtatgagaaaat
5881  tatacagtgcttaattttcagagattctttccatatgttactaaaaaatgttttgttcag
5941  cctaacatactgagttttttttaactttctaaattattgaatttccatcatgcattcatc
6001  caaaattaaggcagactgtttggattcttccagtggccagatgagctaaattaaatcaca
6061  aaagcagatgcttttgtatgatctccaaattgccaactttaaggaaatattctcttgaaa
6121  ttgtctttaaagatcttttgcagctttgcagatacccagactgagctggaactggaattt
6181  gtcttcctattgactctacttctttaaaagcggctgcccattacattcctcagctgtcct
6241  tgcagttaggtgtacatgtgactgagtgttggccagtgagatgaagtctcctcaaaggaa
6301  ggcagcatgtgtccttttctatcccttcatcttgctgctgggattgtggatataacagga
6361  gccctggcagctgtctccagaggatcaaagccacacccaaagagtaaggcagattagaga
6421  ccagaaagaccttgactacttccctacttccactgcttttcctgcatttaagccattgt
6481  aaatctgggtgtgttacatgaagtgaaaattaattctttctgcccttcagttctttatcc
6541  tgataccatttaacactgtctgaattaactagactgcaataattctttcttttgaaagct
6601  tttaaaggataatgtgcaattcacattaaaattgattttccattgtcaattagttatact
6661  catttttcctgccttgatctttcattagatattttgtatctgcttggaatatattcttc
6721  tttttaactgtgtaattggtaattactaaaactctgtaatctccaaaatattgctatcaa
6781  attacacaccatgttttctatcattctcatagatctgccttataaacatttaaataaaaa
6841  gtactatttaatgattt
```

Figure 3A

Amino acid sequence of 98P4B6 v.1 clone GTD3 (SEQ ID. NO. : 78). The 98P4B6 v.1 clone GTD3 protein has 454 amino acids.

```
  1 MESISMMGSP KSLSETCLPN GINGIKDARK VTVGVIGSGD FAKSLTIRLI RCGYHVVIGS
 61 RNPKFASEFF PHVVDVTHHE DALTKTNIIF VAIHREHYTS LWDLRHLLVG KILIDVSNNM
121 RINQYPESNA EYLASLFPDS LIVKGFNVVS AWALQLGPKD ASRQVYICSN NIQARQQVIE
181 LARQLNFIPI DLGSLSSARE IENLPLRLFT LWRGPVVVAI SLATFFFLYS FVRDVIHPYA
241 RNQQSDFYKI PIEIVNKTLP IVAITLLSLV YLAGLLAAAY QLYYGTKYRR FPPWLETWLQ
301 CRKQLGLLSF FFAMVHVAYS LCLPMRRSER YLFLNMAYQQ VHANIENSWN EEEVWRIEMY
361 ISFGIMSLGL LSLLAVTSIP SVSNALNWRE FSFIQSTLGY VALLISTFHV LIYGWKRAFE
421 EEYYRFYTPP NFVLALVLPS IVILDLLQLC RYPD
```

Figure 3B

Amino acid sequence of 98P4B6 v.2 (SEQ ID. NO. : 79). The 98P4B6 v.2 protein has 45 amino acids.

```
  1 SGSPGLQALSL SLSSGFTPFS CLSLPSSWDY RCPPPCPADF FLYF
```

Figure 3C

Amino acid sequence of 98P4B6 v.5 (SEQ ID. NO. : 80). The 98P4B6 v.5 protein has 419 amino acids.

```
  1 MESISMMGSP KSLSETCLPN GINGIKDARK VTVGVIGSGD FAKSLTIRLI RCGYHVVIGS
 61 RNPKFASEFF PHVVDVTHHE DALTKTNIIF VAIHREHYTS LWDLRHLLVG KILIDVSNNM
121 RINQYPESNA EYLASLFPDS LIVKGFNVVS AWALQLGPKD ASRQVYICSN NIQARQQVIE
181 LARQLNFIPI DLGSLSSARE IENLPLRLFT FWRGPVVVAI SLATFFFLYS FVRDVIHPYA
241 RNQQSDFYKI PIEIVNKTLP IVAITLLSLV YLAGLLAAAY QLYYGTKYRR FPPWLETWLQ
301 CRKQLGLLSF FFAMVHVAYS LCLPMRRSER YLFLNMAYQQ VHANIENSWN EEEVWRIEMY
361 ISFGIMSLGL LSLLAVTSIP SVSNALNWRE FSFIQIFCSF ADTQTELELE FVFLLTLLL
```

Figure 3D

Amino acid sequence of 98P4B6 v.6 clone NP1 (SEQ ID. NO. : 81). The 98P4B6 v.6 clone NP1 protein has 490 amino acids.

```
  1 MESISMMGSP KSLSETCLPN GINGIKDARK VTVGVIGSGD FAKSLTIRLI RCGYHVVIGS
 61 RNPKFASEFF PHVVDVTHHE DALTKTNIIF VAIHREHYTS LWDLRHLLVG KILIDVSNNM
121 RINQYPESNA EYLASLFPDS LIVKGFNVVS AWALQLGPKD ASRQVYICSN NIQARQQVIE
181 LARQLNFIPI DLGSLSSARE IENLPLRLFT LWRGPVVVAI SLATFFFLYS FVRDVIHPYA
241 RNQQSDFYKI PIEIVNKTLP IVAITLLSLV YLAGLLAAAY QLYYGTKYRR FPPWLETWLQ
301 CRKQLGLLSF FFAMVHVAYS LCLPMRRSER YLFLNMAYQQ VHANIENSWN EEEVWRIEMY
361 ISFGIMSLGL LSLLAVTSIP SVSNALNWRE FSFIQSTLGY VALLISTFHV LIYGWKRAFE
421 EEYYRFYTPP NFVLALVLPS IVILGKIILF LPCISRKLKR IKKGWEKSQF LEEGIGGTIP
481 HVSPERVTVM
```

Figure 3E

Amino acid sequence of 98P4B6 v.7 (SEQ ID. NO. : 82). The 98P4B6 v.7 protein has 576 amino acids.

```
  1 MESISMMGSP KSLSETFLPN GINGIKDARK VTVGVIGSGD FAKSLTIRLI RCGYHVVIGS
 61 RNPKFASEFF PHVVDVTHHE DALTKTNIIF VAIHREHYTS LWDLRHLLVG KILIDVSNNM
121 RINQYPESNA EYLASLFPDS LIVKGFNVVS AWALQLGPKD ASRQVYICSN NIQARQQVIE
181 LARQLNFIPI DLGSLSSARE IENLPLRLFT LWRGPVVVAI SLATFFFLYS FVRDVIHPYA
241 RNQQSDFYKI PIEIVNKTLP IVAITLLSLV YLAGLLAAAY QLYYGTKYRR FPPWLETWLQ
301 CRKQLGLLSF FFAMVHVAYS LCLPMRRSER YLFLNMAYQQ STLGYVALLI STFHVLIYGW
361 KRAFEEEYYR FYTPPNFVLA LVLPSIVILD LSVEVLASPA AAWKCLGANI LRGGLSEIVL
421 PIEWQQDRKI PPLSTPPPPA MWTEEAGATA EAQESGIRNK SSSSSQIPVV GVVTEDDEAQ
481 DSIDPPESPD RALKAANSWR NPVLPHTNGV GPLWEFLLRL LKSQAASGTL SLAFTSWSLG
541 EFLGSGTWMK LETIILSKLT QEQKSKHCMF SLISGS
```

Figure 3F

Amino acid sequence of 98P4B6 v.8 (SEQ ID. NO. : 83). The 98P4B6 v.8 protein has 490 amino acids.

```
  1 MESISMMGSP KSLSETCLPN GINGIKDARK VTVGVIGSGD FAKSLTIRLI RCGYHVVIGS
 61 RNPKFASEFF PHVVDVTHHE DALTKTNIIF VAIHREHYTS LWDLRHLLVG KILIDVSNNM
121 RINQYPESNA EYLASLFPDS LIVKGFNVVS AWALQLGPKD ASRQVYICSN NIQARQQVIE
181 LARQLNFIPI DLGSLSSARE IENLPLRLFT LWRGPVVVAI SLATFFFLYS FVRDVIHPYA
241 RNQQSDFYKI PIEIVNKTLP IVAITLLSLV YLAGLLAAAY QLYYGTKYRR FPPWLETWLQ
301 CRKQLGLLSF FFAMVHVAYS LCLPMRRSER YLFLNMAYQQ VHANIENSWN EEEVWRIEMY
361 ISFGIMSLGL LSLLAVTSIP SVSNALNWRE FSFIQSTLGY VALLISTFHV LIYGWKRAFE
421 EEYYRFYTPP NFVLALVLPS IVILGKIILF LPCISRKLKR IKKGWEKSQF LEEGMGGTIP
481 HVSPERVTVM
```

Figure 3G

Amino acid sequence of 98P4B6 v.13 (SEQ ID. NO. : 84). The 98P4B6 v.13 protein has 454 amino acids.

```
  1 MESISMMGSP KSLSETFLPN GINGIKDARK VTVGVIGSGD FAKSLTIRLI RCGYHVVIGS
 61 RNPKFASEFF PHVVDVTHHE DALTKTNIIF VAIHREHYTS LWDLRHLLVG KILIDVSNNM
121 RINQYPESNA EYLASLFPDS LIVKGFNVVS AWALQLGPKD ASRQVYICSN NIQARQQVIE
181 LARQLNFIPI DLGSLSSARE IENLPLRLFT LWRGPVVVAI SLATFFFLYS FVRDVIHPYA
241 RNQQSDFYKI PIEIVNKTLP IVAITLLSLV YLAGLLAAAY QLYYGTKYRR FPPWLETWLQ
301 CRKQLGLLSF FFAMVHVAYS LCLPMRRSER YLFLNMAYQQ VHANIENSWN EEEVWRIEMY
361 ISFGIMSLGL LSLLAVTSIP SVSNALNWRE FSFIQSTLGY VALLISTFHV LIYGWKRAFE
421 EEYYRFYTPP NFVLALVLPS IVILDLLQLC RYPD
```

Figure 3H

Amino acid sequence of 98P4B6 v.14 (SEQ ID. NO. : 85). The 98P4B6 v.14 protein has 454 amino acids.

```
  1 MESISMMGSP KSLSETFLPN GINGIKDARK VTVGVIGSGD FAKSLTIRLI RCGYHVVIGS
 61 RNPKFASEFF PHVVDVTHHE DALTKTNIIF VAIHREHYTS LWDLRHLLVG KILIDVSNNM
121 RINQYPESNA EYLASLFPDS LIVKGFNVVS AWALQLGPKD ASRQVYICSN NIQARQQVIE
181 LARQLNFIPI DLGSLSSARE IENLPLRLFT FWRGPVVVAI SLATFFFLYS FVRDVIHPYA
241 RNQQSDFYKI PIEIVNKTLP IVAITLLSLV YLAGLLAAAY QLYYGTKYRR FPPWLETWLQ
301 CRKQLGLLSF FFAMVHVAYS LCLPMRRSER YLFLNMAYQQ VHANIENSWN EEEVWRIEMY
361 ISFGIMSLGL LSLLAVTSIP SVSNALNWRE FSFIQSTLGY VALLISTFHV LIYGWKRAFE
421 EEYYRFYTPP NFVLALVLPS IVILDLLQLC RYPD
```

Figure 3I

Amino acid sequence of 98P4B6 v.21 (SEQ ID. NO. : 86). The 98P4B6 v.21 protein has 576 amino acids.

```
  1 MESISMMGSP KSLSETFLPN GINGIKDARK VTVGVIGSGD FAKSLTIRLI RCGYHVVIGS
 61 RNPKFASEFF PHVVDVTHHE DALTKTNIIF VAIHREHYTS LWDLRHLLVG KILIDVSNNM
121 RINQYPESNA EYLASLFPDS LIVKGFNVVS AWALQLGPKD ASRQVYICSN NIQARQQVIE
181 LARQLNFIPI DLGSLSSARE IENLPLRLFT LWRGPVVVAI SLATFFFLYS FVRDVIHPYA
241 RNQQSDFYKI PIEIVNKTLP IVAITLLSLV YLAGLLAAAY QLYYGTKYRR FPPWLETWLQ
301 CRKQLGLLSF FFAMVHVAYS LCLPMRRSER YLFLNMAYQQ STLGYVALLI STFHVLIYGW
361 KRAFEEEYYR FYTPPNFVLA LVLPSIVILD LSVEVLASPA AAWKCLGANI LRGGLSEIVL
421 PIEWQQDRKI PPLSTPPPPA MWTEEAGATA EAQESGIRNK SSSSSQIPVV GVVTEDDEAQ
481 DSIDPPESPD RALKAANSWR NPVLPHTNGV GPLWEFLLRL LKSQAASGTL SLAFTSWSLG
541 EFLGSGTWMK LETIILSKLT QEQKTKHCMF SLISGS
```

Figure 3J

Amino acid sequence of 98P4B6 v.25 (SEQ ID. NO. : 87). The 98P4B6 v.25 protein has 490 amino acids.

```
  1 MESISMMGSP KSLSETCLPN GINGIKDARK VTVGVIGSGD FAKSLTIRLI RCGYHVVIGS
 61 RNPKFASEFF PHVVDVTHHE DALTKTNIIF VAIHREHYTS LWDLRHLLVG KILIDVSNNM
121 RINQYPESNA EYLASLFPDS LIVKGFNVVS AWALQLGPKD ASRQVYICSN NIQARQQVIE
181 LARQLNFIPI DLGSLSSARE IENLPLRLFT LWRGPVVVAI SLATFFFLYS FVRDVIHPYA
241 RNQQSDFYKI PIEIVNKTLP IVAITLLSLV YLAGLLAAAY QLYYGTKYRR FPPWLETWLQ
301 CRKQLGLLSF FFAMVHVAYS LCLPMRRSER YLFLNMAYQQ VHANIENSWN EEEVWRIEMY
361 ISFGIMSLGL LSLLAVTSIP SVSNALNWRE FSFIQSTLGY VALLISTFHV LIYGWKRAFE
421 EEYYRFYTPP NFVLALVLPS IVILGKIILF LPCISQKLKR IKKGWEKSQF LEEGMGGTIP
481 HVSPERVTVM
```

Figure 4A

Alignment of 98P4B6 variant 1 (SEQ ID NO: 88) to human STAMP1 (gi 15418732) (SEQ ID NO: 89).

Identities = 443/444 (99%), Positives = 443/444 (99%)

```
Query:   1   MESISMMGSPKSLSETCLPNGINGIKDARKVTVGVIGSGDFAKSLTIRLIRCGYHVVIGS   60
             MESISMMGSPKSLSETCLPNGINGIKDARKVTVGVIGSGDFAKSLTIRLIRCGYHVVIGS
Sbjct:   1   MESISMMGSPKSLSETCLPNGINGIKDARKVTVGVIGSGDFAKSLTIRLIRCGYHVVIGS   60

Query:  61   RNPKFASEFFPHVVDVTHHEDALTKTNIIFVAIHREHYTSLWDLRHLLVGKILIDVSNNM  120
             RNPKFASEFFPHVVDVTHHEDALTKTNIIFVAIHREHYTSLWDLRHLLVGKILIDVSNNM
Sbjct:  61   RNPKFASEFFPHVVDVTHHEDALTKTNIIFVAIHREHYTSLWDLRHLLVGKILIDVSNNM  120

Query: 121   RINQYPESNAEYLASLFPDSLIVKGFNVVSAWALQLGPKDASRQVYICSNNIQARQQVIE  180
             RINQYPESNAEYLASLFPDSLIVKGFNVVSAWALQLGPKDASRQVYICSNNIQARQQVIE
Sbjct: 121   RINQYPESNAEYLASLFPDSLIVKGFNVVSAWALQLGPKDASRQVYICSNNIQARQQVIE  180

Query: 181   LARQLNFIPIDLGSLSSAREIENLPLRLFTLWRGPVVVAISLATFFFLYSFVRDVIHPYA  240
             LARQLNFIPIDLGSLSSAREIENLPLRLFT WRGPVVVAISLATFFFLYSFVRDVIHPYA
Sbjct: 181   LARQLNFIPIDLGSLSSAREIENLPLRLFTFWRGPVVVAISLATFFFLYSFVRDVIHPYA  240

Query: 241   RNQQSDFYKIPIEIVNKTLPIVAITLLSLVYLAGLLAAAYQLYYGTKYRRFPPWLETWLQ  300
             RNQQSDFYKIPIEIVNKTLPIVAITLLSLVYLAGLLAAAYQLYYGTKYRRFPPWLETWLQ
Sbjct: 241   RNQQSDFYKIPIEIVNKTLPIVAITLLSLVYLAGLLAAAYQLYYGTKYRRFPPWLETWLQ  300

Query: 301   CRKQLGLLSFFFAMVHVAYSLCLPMRRSERYLFLNMAYQQVHANIENSWNEEEVWRIEMY  360
             CRKQLGLLSFFFAMVHVAYSLCLPMRRSERYLFLNMAYQQVHANIENSWNEEEVWRIEMY
Sbjct: 301   CRKQLGLLSFFFAMVHVAYSLCLPMRRSERYLFLNMAYQQVHANIENSWNEEEVWRIEMY  360

Query: 361   ISFGIMSLGLLSLLAVTSIPSVSNALNWREFSFIQSTLGYVALLISTFHVLIYGWKRAFE  420
             ISFGIMSLGLLSLLAVTSIPSVSNALNWREFSFIQSTLGYVALLISTFHVLIYGWKRAFE
Sbjct: 361   ISFGIMSLGLLSLLAVTSIPSVSNALNWREFSFIQSTLGYVALLISTFHVLIYGWKRAFE  420

Query: 421   EEYYRFYTPPNFVLALVLPSIVIL  444
             EEYYRFYTPPNFVLALVLPSIVIL
Sbjct: 421   EEYYRFYTPPNFVLALVLPSIVIL  444
```

Figure 4B

Alignment of 98P4B6 variant 1 (SEQ ID NO: 90) with human STEAP2 (gi:23308593) (SEQ ID NO: 91).

Identities = 443/444 (99%), Positives = 443/444 (99%)

```
Query:   1   MESISMMGSPKSLSETCLPNGINGIKDARKVTVGVIGSGDFAKSLTIRLIRCGYHVVIGS   60
             MESISMMGSPKSLSET LPNGINGIKDARKVTVGVIGSGDFAKSLTIRLIRCGYHVVIGS
Sbjct:   1   MESISMMGSPKSLSETVLPNGINGIKDARKVTVGVIGSGDFAKSLTIRLIRCGYHVVIGS   60

Query:  61   RNPKFASEFFPHVVDVTHHEDALTKTNIIFVAIHREHYTSLWDLRHLLVGKILIDVSNNM  120
             RNPKFASEFFPHVVDVTHHEDALTKTNIIFVAIHREHYTSLWDLRHLLVGKILIDVSNNM
Sbjct:  61   RNPKFASEFFPHVVDVTHHEDALTKTNIIFVAIHREHYTSLWDLRHLLVGKILIDVSNNM  120

Query: 121   RINQYPESNAEYLASLFPDSLIVKGFNVVSAWALQLGPKDASRQVYICSNNIQARQQVIE  180
             RINQYPESNAEYLASLFPDSLIVKGFNVVSAWALQLGPKDASRQVYICSNNIQARQQVIE
Sbjct: 121   RINQYPESNAEYLASLFPDSLIVKGFNVVSAWALQLGPKDASRQVYICSNNIQARQQVIE  180

Query: 181   LARQLNFIPIDLGSLSSAREIENLPLRLFTLWRGPVVVAISLATFFFLYSFVRDVIHPYA  240
             LARQLNFIPIDLGSLSSAREIENLPLRLFTLWRGPVVVAISLATFFFLYSFVRDVIHPYA
Sbjct: 181   LARQLNFIPIDLGSLSSAREIENLPLRLFTLWRGPVVVAISLATFFFLYSFVRDVIHPYA  240

Query: 241   RNQQSDFYKIPIEIVNKTLPIVAITLLSLVYLAGLLAAAYQLYYGTKYRRFPPWLETWLQ  300
             RNQQSDFYKIPIEIVNKTLPIVAITLLSLVYLAGLLAAAYQLYYGTKYRRFPPWLETWLQ
Sbjct: 241   RNQQSDFYKIPIEIVNKTLPIVAITLLSLVYLAGLLAAAYQLYYGTKYRRFPPWLETWLQ  300

Query: 301   CRKQLGLLSFFFAMVHVAYSLCLPMRRSERYLFLNMAYQQVHANIENSWNEEEVWRIEMY  360
             CRKQLGLLSFFFAMVHVAYSLCLPMRRSERYLFLNMAYQQVHANIENSWNEEEVWRIEMY
Sbjct: 301   CRKQLGLLSFFFAMVHVAYSLCLPMRRSERYLFLNMAYQQVHANIENSWNEEEVWRIEMY  360

Query: 361   ISFGIMSLGLLSLLAVTSIPSVSNALNWREFSFIQSTLGYVALLISTFHVLIYGWKRAFE  420
             ISFGIMSLGLLSLLAVTSIPSVSNALNWREFSFIQSTLGYVALLISTFHVLIYGWKRAFE
Sbjct: 361   ISFGIMSLGLLSLLAVTSIPSVSNALNWREFSFIQSTLGYVALLISTFHVLIYGWKRAFE  420

Query: 421   EEYYRFYTPPNFVLALVLPSIVIL  444
             EEYYRFYTPPNFVLALVLPSIVIL
Sbjct: 421   EEYYRFYTPPNFVLALVLPSIVIL  444
```

Figure 4C

Alignment of 98P4B6 variant 1 (SEQ ID NO: 92) with mouse STEAP2 (gi 28501136) (SEQ ID NO: 93).

Identities = 432/444 (97%), Positives = 441/444 (99%), Gaps = 1/444 (0%)

```
Query:   1  MESISMMGSPKSLSETCLPNGINGIKDARKVTVGVIGSGDFAKSLTIRLIRCGYHVVIGS  60
            MESISMMGSPKSL ET LPNGINGIKDAR+VTVGVIGSGDFAKSLTIRLIRCGYHVVIGS
Sbjct:   1  MESISMMGSPKSL-ETFLPNGINGIKDARQVTVGVIGSGDFAKSLTIRLIRCGYHVVIGS  59

Query:  61  RNPKFASEFFPHVVDVTHHEDALTKTNIIFVAIHREHYTSLWDLRHLLVGKILIDVSNNM  120
            RNPKFASEFFPHVVDVTHHEDALTKTNIIFVAIHREHYTSLWDLRHLLVGKILIDVSNNM
Sbjct:  60  RNPKFASEFFPHVVDVTHHEDALTKTNIIFVAIHREHYTSLWDLRHLLVGKILIDVSNNM  119

Query: 121  RINQYPESNAEYLASLFPDSLIVKGFNVVSAWALQLGPKDASRQVYICSNNIQARQQVIE  180
            R+NQYPESNAEYLASLFPDSLIVKGFNV+SAWALQLGPKDASRQVYICSNNIQARQQVIE
Sbjct: 120  RVNQYPESNAEYLASLFPDSLIVKGFNVISAWALQLGPKDASRQVYICSNNIQARQQVIE  179

Query: 181  LARQLNFIPIDLGSLSSAREIENLPLRLFTLWRGPVVVAISLATFFFLYSFVRDVIHPYA  240
            LARQLNFIP+DLGSLSSA+EIENLPLRLFTLWRGPVVVAISLATFFFLYSFVRDVIHPYA
Sbjct: 180  LARQLNFIPVDLGSLSSAKEIENLPLRLFTLWRGPVVVAISLATFFFLYSFVRDVIHPYA  239

Query: 241  RNQQSDFYKIPIEIVNKTLPIVAITLLSLVYLAGLLAAAYQLYYGTKYRRFPPWLETWLQ  300
            RNQQSDFYKIPIEIVNKTLPIVAITLLSLVYLAGLLAAAYQLYYGTKYRRFPPWL+TWLQ
Sbjct: 240  RNQQSDFYKIPIEIVNKTLPIVAITLLSLVYLAGLLAAAYQLYYGTKYRRFPPWLDTWLQ  299

Query: 301  CRKQLGLLSFFFAMVHVAYSLCLPMRRSERYLFLNMAYQQVHANIENSWNEEEVWRIEMY  360
            CRKQLGLLSFFFA+VHVAYSLCLPMRRSERYLFLNMAYQQVHANIEN+WNEEEVWRIEMY
Sbjct: 300  CRKQLGLLSFFFAVVHVAYSLCLPMRRSERYLFLNMAYQQVHANIENAWNEEEVWRIEMY  359

Query: 361  ISFGIMSLGLLSLLAVTSIPSVSNALNWREFSFIQSTLGYVALLISTFHVLIYGWKRAFE  420
            ISFGIMSLGLLSLLAVTSIPSVSNALNWREFSFIQSTLGYVALLI+TFHVLIYGWKRAF
Sbjct: 360  ISFGIMSLGLLSLLAVTSIPSVSNALNWREFSFIQSTLGYVALLITTFHVLIYGWKRAFA  419

Query: 421  EEYYRFYTPPNFVLALVLPSIVIL  444
            EEYYRFYTPPNFVLALVLPSIVIL
Sbjct: 420  EEYYRFYTPPNFVLALVLPSIVIL  443
```

Figure 4D

Clustal Alignment of the three 98P4B6 variants, depicting that 98P4B6 V1B (SEQ ID NO: 94) contains an additional 62 aa at its N-terminus relative to V1 (SEQ ID NO: 95), and that 98P4B6 V2 (SEQ ID NO: 96) carries a I to T point mutation at aa 225 relative to V1.

```
v.1A      ---------------------------------------------------------------
v.1B      FITSTLQNITSTSIIFLLTGVPGLEAFHTWISIPFCFLSVTALLGNSLILFATITQPSLH
v.2       --------------------------------------------------------------- v.1A      --MYYFLSMLSATDLGLSISTLVTMLSIFWFNVREISFNACLSHMFFIKFFTVMESSVLL
v.1B      EPMYYFLSMLSATDLGLSISTLVTMLSIFWFNVREISFNACLSHMFFIKFFTVMESSVLL
v.2       --MYYFLSMLSATDLGLSISTLVTMLSIFWFNVREISFNACLSHMFFIKFFTVMESSVLL
            ************************************************************ v.1A      AMAFDRFVAVSNPLRYAMILTDSRIAQIGVASVIRGLLMLTPMVALLIRLSYCHSQVLHH
v.1B      AMAFDRFVAVSNPLRYAMILTDSRIAQIGVASVIRGLLMLTPMVALLIRLSYCHSQVLHH
v.2       AMAFDRFVAVSNPLRYAMILTDSRIAQIGVASVIRGLLMLTPMVALLIRLSYCHSQVLHH
          ************************************************************ v.1A      SYCYHPDVMKLSCTDTRINSAVGLTAMFSTVGVDLLLILLSYVLIIRTVLSVASPEERKE
v.1B      SYCYHPDVMKLSCTDTRINSAVGLTAMFSTVGVDLLLILLSYVLIIRTVLSVASPEERKE
v.2       SYCYHPDVMKLSCTDTRINSAVGLTAMFSTVGVDLLLILLSYVLIIRTVLSVASPEERKE
          ************************************************************ v.1A      TFSTCVSHIVAFAIYYIPLISLSIVHRFGKQAPAYVHTMIANTYLLISPLMNPVIYSVKT
v.1B      TFSTCVSHIVAFAIYYIPLISLSIVHRFGKQAPAYVHTMIANTYLLISPLMNPVIYSVKT
v.2       TFSTCVSHIVAFAIYYIPLISLSIVHRFGKQAPAYVHTMIANTYLLTSPLMNPVIYSVKT
          ******************************** ********* ********** v.1A      KQIRRAVIKILHSKET
v.1B      KQIRRAVIKILHSKET
v.2       KQIRRAVIKILHSKET
          ****************
```

NUCLEIC ACID AND CORRESPONDING PROTEIN ENTITLED 98P4B6 USEFUL IN TREATMENT AND DETECTION OF CANCER

CROSS-REFERENCE TO RELATED APPLICATIONS

This application is a continuation of U.S. patent application Ser. No. 10/407,484, filed Apr. 4, 2003, which is a continuation-in-part of U.S. patent application Ser. No. 09/455,486, filed Dec. 6, 1999, now issued as U.S. Pat. No. 6,833,438 on Dec. 21, 2004, which is a continuation-in-part of U.S. patent application Ser. No. 09/323,873, filed Jun. 1, 1999, now issued as U.S. Pat. No. 6,329,503 on Dec. 11, 2001, which claims the benefit of U.S. Provisional Application No. 60/091,183, filed Jun. 30, 1998 and U.S. Provisional Application No. 60/087,520, filed Jun. 1, 1998. This application relates to U.S. Provisional Application No. 60/370,387, filed Apr. 5, 2002, U.S. Provisional Application No. 60/435,480, filed Dec. 20, 2002, U.S. patent application Ser. No. 10/455,822, filed Jun. 4, 2003, U.S. patent application Ser. No. 10/862,182, filed Jun. 4, 2004, now abandoned, U.S. application Ser. No. 11/068,859, filed Feb. 28, 2005, U.S. Provisional Application No. 60/296,656, filed Jun. 6, 2001, U.S. patent application Ser. No. 10/165,044, filed Jun. 6, 2002, and U.S. patent application Ser. No. 10/753,195, filed Jan. 6, 2004. The contents of the applications listed in this paragraph are fully incorporated by reference herein.

STATEMENT OF RIGHTS TO INVENTIONS MADE UNDER FEDERALLY SPONSORED RESEARCH

Not applicable.

FIELD OF THE INVENTION

The invention described herein relates to genes and their encoded proteins, termed 98P4B6 or STEAP-2, expressed in certain cancers, and to diagnostic and therapeutic methods and compositions useful in the management of cancers that express 98P4B6.

BACKGROUND OF THE INVENTION

Cancer is the second leading cause of human death next to coronary disease. Worldwide, millions of people die from cancer every year. In the United States alone, as reported by the American Cancer Society, cancer causes the death of well over a half-million people annually, with over 1.2 million new cases diagnosed per year. While deaths from heart disease have been declining significantly, those resulting from cancer generally are on the rise. In the early part of the next century, cancer is predicted to become the leading cause of death.

Worldwide, several cancers stand out as the leading killers. In particular, carcinomas of the lung, prostate, breast, colon, pancreas, and ovary represent the primary causes of cancer death. These and virtually all other carcinomas share a common lethal feature. With very few exceptions, metastatic disease from a carcinoma is fatal. Moreover, even for those cancer patients who initially survive their primary cancers, common experience has shown that their lives are dramatically altered. Many cancer patients experience strong anxieties driven by the awareness of the potential for recurrence or treatment failure. Many cancer patients experience physical debilitations following treatment. Furthermore, many cancer patients experience a recurrence.

Worldwide, prostate cancer is the fourth most prevalent cancer in men. In North America and Northern Europe, it is by far the most common cancer in males and is the second leading cause of cancer death in men. In the United States alone, well over 30,000 men die annually of this disease—second only to lung cancer. Despite the magnitude of these figures, there is still no effective treatment for metastatic prostate cancer. Surgical prostatectomy, radiation therapy, hormone ablation therapy, surgical castration and chemotherapy continue to be the main treatment modalities. Unfortunately, these treatments are ineffective for many and are often associated with undesirable consequences.

On the diagnostic front, the lack of a prostate tumor marker that can accurately detect early-stage, localized tumors remains a significant limitation in the diagnosis and management of this disease. Although the serum prostate specific antigen (PSA) assay has been a very useful tool, however its specificity and general utility is widely regarded as lacking in several important respects.

Progress in identifying additional specific markers for prostate cancer has been improved by the generation of prostate cancer xenografts that can recapitulate different stages of the disease in mice. The LAPC (Los Angeles Prostate Cancer) xenografts are prostate cancer xenografts that have survived passage in severe combined immune deficient (SCID) mice and have exhibited the capacity to mimic the transition from androgen dependence to androgen independence (Klein et al., 1997, Nat. Med. 3:402). More recently identified prostate cancer markers include PCTA-1 (Su et al., 1996, Proc. Natl. Acad. Sci. USA 93: 7252), prostate-specific membrane (PSM) antigen (Pinto et al., Clin Cancer Res 1996 Sep. 2 (9): 1445-51), STEAP (Hubert, et al., Proc Natl Acad Sci USA. 1999 Dec. 7; 96(25): 14523-8) and prostate stem cell antigen (PSCA) (Reiter et al., 1998, Proc. Natl. Acad. Sci. USA 95: 1735).

While previously identified markers such as PSA, PSM, PCTA and PSCA have facilitated efforts to diagnose and treat prostate cancer, there is need for the identification of additional markers and therapeutic targets for prostate and related cancers in order to further improve diagnosis and therapy.

Renal cell carcinoma (RCC) accounts for approximately 3 percent of adult malignancies. Once adenomas reach a diameter of 2 to 3 cm, malignant potential exists. In the adult, the two principal malignant renal tumors are renal cell adenocarcinoma and transitional cell carcinoma of the renal pelvis or ureter. The incidence of renal cell adenocarcinoma is estimated at more than 29,000 cases in the United States, and more than 11,600 patients died of this disease in 1998. Transitional cell carcinoma is less frequent, with an incidence of approximately 500 cases per year in the United States.

Surgery has been the primary therapy for renal cell adenocarcinoma for many decades. Until recently, metastatic disease has been refractory to any systemic therapy. With recent developments in systemic therapies, particularly immunotherapies, metastatic renal cell carcinoma may be approached aggressively in appropriate patients with a possibility of durable responses. Nevertheless, there is a remaining need for effective therapies for these patients.

Of all new cases of cancer in the United States, bladder cancer represents approximately 5 percent in men (fifth most common neoplasm) and 3 percent in women (eighth most common neoplasm). The incidence is increasing slowly, concurrent with an increasing older population. In 1998, there was an estimated 54,500 cases, including 39,500 in men and 15,000 in women. The age-adjusted incidence in the United States is 32 per 100,000 for men and eight per 100,000 in women. The historic male/female ratio of 3:1 may be decreasing related to smoking patterns in women. There were an estimated 11,000 deaths from bladder cancer in 1998 (7,800 in men and 3,900 in women). Bladder cancer incidence and mortality strongly increase with age and will be an increasing problem as the population becomes more elderly.

Most bladder cancers recur in the bladder. Bladder cancer is managed with a combination of transurethral resection of the bladder (TUR) and intravesical chemotherapy or immunotherapy. The multifocal and recurrent nature of bladder cancer points out the limitations of TUR. Most muscle-invasive cancers are not cured by TUR alone. Radical cystectomy and urinary diversion is the most effective means to eliminate the cancer but carry an undeniable impact on urinary and sexual function. There continues to be a significant need for treatment modalities that are beneficial for bladder cancer patients.

An estimated 130,200 cases of colorectal cancer occurred in 2000 in the United States, including 93,800 cases of colon cancer and 36,400 of rectal cancer. Colorectal cancers are the third most common cancers in men and women. Incidence rates declined significantly during 1992-1996 (−2.1% per year). Research suggests that these declines have been due to increased screening and polyp removal, preventing progression of polyps to invasive cancers. There were an estimated 56,300 deaths (47,700 from colon cancer, 8,600 from rectal cancer) in 2000, accounting for about 11% of all U.S. cancer deaths.

At present, surgery is the most common form of therapy for colorectal cancer, and for cancers that have not spread, it is frequently curative. Chemotherapy, or chemotherapy plus radiation, is given before or after surgery to most patients whose cancer has deeply perforated the bowel wall or has spread to the lymph nodes. A permanent colostomy (creation of an abdominal opening for elimination of body wastes) is occasionally needed for colon cancer and is infrequently required for rectal cancer. There continues to be a need for effective diagnostic and treatment modalities for colorectal cancer.

There were an estimated 164,100 new cases of lung and bronchial cancer in 2000, accounting for 14% of all U.S. cancer diagnoses. The incidence rate of lung and bronchial cancer is declining significantly in men, from a high of 86.5 per 100,000 in 1984 to 70.0 in 1996. In the 1990s, the rate of increase among women began to slow. In 1996, the incidence rate in women was 42.3 per 100,000.

Lung and bronchial cancer caused an estimated 156,900 deaths in 2000, accounting for 28% of all cancer deaths. During 1992-1996, mortality from lung cancer declined significantly among men (−1.7% per year) while rates for women were still significantly increasing (0.9% per year). Since 1987, more women have died each year of lung cancer than breast cancer, which, for over 40 years, was the major cause of cancer death in women. Decreasing lung cancer incidence and mortality rates most likely resulted from decreased smoking rates over the previous 30 years; however, decreasing smoking patterns among women lag behind those of men. Of concern, although the declines in adult tobacco use have slowed, tobacco use in youth is increasing again.

Treatment options for lung and bronchial cancer are determined by the type and stage of the cancer and include surgery, radiation therapy, and chemotherapy. For many localized cancers, surgery is usually the treatment of choice. Because the disease has usually spread by the time it is discovered, radiation therapy and chemotherapy are often needed in combination with surgery. Chemotherapy alone or combined with radiation is the treatment of choice for small cell lung cancer; on this regimen, a large percentage of patients experience remission, which in some cases is long lasting. There is however, an ongoing need for effective treatment and diagnostic approaches for lung and bronchial cancers.

An estimated 182,800 new invasive cases of breast cancer were expected to occur among women in the United States during 2000. Additionally, about 1,400 new cases of breast cancer were expected to be diagnosed in men in 2000. After increasing about 4% per year in the 1980s, breast cancer incidence rates in women have leveled off in the 1990s to about 110.6 cases per 100,000.

In the U.S. alone, there were an estimated 41,200 deaths (40,800 women, 400 men) in 2000 due to breast cancer. Breast cancer ranks second among cancer deaths in women. According to the most recent data, mortality rates declined significantly during 1992-1996 with the largest decreases in younger women, both white and black. These decreases were probably the result of earlier detection and improved treatment.

Taking into account the medical circumstances and the patient's preferences, treatment of breast cancer may involve lumpectomy (local removal of the tumor) and removal of the lymph nodes under the arm; mastectomy (surgical removal of the breast) and removal of the lymph nodes under the arm; radiation therapy; chemotherapy; or hormone therapy. Often, two or more methods are used in combination. Numerous studies have shown that, for early stage disease, long-term survival rates after lumpectomy plus radiotherapy are similar to survival rates after modified radical mastectomy. Significant advances in reconstruction techniques provide several options for breast reconstruction after mastectomy: Recently, such reconstruction has been done at the same time as the mastectomy.

Local excision of ductal carcinoma in situ (DCIS) with adequate amounts of surrounding normal breast tissue may prevent the local recurrence of the DCIS. Radiation to the breast and/or tamoxifen may reduce the chance of DCIS occurring in the remaining breast tissue. This is important because DCIS, if left untreated, may develop into invasive breast cancer. Nevertheless, there are serious side effects or sequelae to these treatments. There is, therefore, a need for efficacious breast cancer treatments.

There were an estimated 23,100 new cases of ovarian cancer in the United States in 2000. It accounts for 4% of all cancers among women and ranks second among gynecologic cancers. During 1992-1996, ovarian cancer incidence rates were significantly declining. Consequent to ovarian cancer, there were an estimated 14,000 deaths in 2000. Ovarian cancer causes more deaths than any other cancer of the female reproductive system.

Surgery, radiation therapy, and chemotherapy are treatment options for ovarian cancer. Surgery usually includes the removal of one or both ovaries, the fallopian tubes (salpingo-oophorectomy), and the uterus (hysterectomy). In some very early tumors, only the involved ovary will be removed, especially in young women who wish to have children. In advanced disease, an attempt is made to remove all intra-abdominal disease to enhance the effect of chemotherapy. There continues to be an important need for effective treatment options for ovarian cancer.

There were an estimated 28,300 new cases of pancreatic cancer in the United States in 2000. Over the past 20 years, rates of pancreatic cancer have declined in men. Rates among women have remained approximately constant but may be beginning to decline. Pancreatic cancer caused an estimated 28,200 deaths in 2000 in the United States. Over the past 20 years, there has been a slight but significant decrease in mortality rates among men (about −0.9% per year) while rates have increased slightly among women.

Surgery, radiation therapy, and chemotherapy are treatment options for pancreatic cancer. These treatment options can extend survival and/or relieve symptoms in many patients but are not likely to produce a cure for most. There is a significant need for additional therapeutic and diagnostic options for pancreatic cancer.

SUMMARY OF THE INVENTION

The present invention relates to a gene, designated 98P4B6, that has now been found to be over-expressed in the cancer(s) listed in Table I. Northern blot expression analysis of 98P4B6 gene expression in normal tissues shows a restricted expression pattern in adult tissues. The nucleotide (FIG. 2) and amino acid (FIG. 2, and FIG. 3) sequences of 98P4B6 are provided. The tissue-related profile of 98P4B6 in normal adult tissues, combined with the over-expression observed in the tissues listed in Table I, shows that 98P4B6 is aberrantly over-expressed in at least some cancers, and thus serves as a useful diagnostic, prophylactic, prognostic, and/or therapeutic target for cancers of the tissue(s) such as those listed in Table I.

The invention provides polynucleotides corresponding or complementary to all or part of the 98P4B6 genes, mRNAs, and/or coding sequences, preferably in isolated form, including polynucleotides encoding 98P4B6-related proteins and fragments of 4, 5, 6, 7, 8, 9, 10, 11, 12, 13, 14, 15, 16, 17, 18, 19, 20, 21, 22, 23, 24, 25, or more than 25 contiguous amino acids; at least 30, 35, 40, 45, 50, 55, 60, 65, 70, 80, 85, 90, 95, 100 or more than 100 contiguous amino acids of a 98P4B6-related protein, as well as the peptides/proteins themselves; DNA, RNA, DNA/RNA hybrids, and related molecules, polynucleotides or oligonucleotides complementary or having at least a 90% homology to the 98P4B6 genes or mRNA sequences or parts thereof, and polynucleotides or oligonucleotides that hybridize to the 98P4B6 genes, mRNAs, or to 98P4B6-encoding polynucleotides. Also provided are means for isolating cDNAs and the genes encoding 98P4B6. Recombinant DNA molecules containing 98P4B6 polynucleotides, cells transformed or transduced with such molecules, and host-vector systems for the expression of 98P4B6 gene products are also provided. The invention further provides antibodies that bind to 98P4B6 proteins and polypeptide fragments thereof, including polyclonal and monoclonal antibodies, murine and other mammalian antibodies, chimeric antibodies, humanized and fully human antibodies, and antibodies labeled with a detectable marker or therapeutic agent. In certain embodiments, there is a proviso that the entire nucleic acid sequence of FIG. 2 is not encoded and/or the entire amino acid sequence of FIG. 2 is not prepared. In certain embodiments, the entire nucleic acid sequence of FIG. 2 is encoded and/or the entire amino acid sequence of FIG. 2 is prepared, either of which are in respective human unit dose forms.

The invention further provides methods for detecting the presence and status of 98P4B6 polynucleotides and proteins in various biological samples, as well as methods for identifying cells that express 98P4B6. A typical embodiment of this invention provides methods for monitoring 98P4B6 gene products in a tissue or hematology sample having or suspected of having some form of growth dysregulabton such as cancer.

The invention further provides various immunogenic or therapeutic compositions and strategies for treating cancers that express 98P4B6 such as cancers of tissues listed in Table I, including therapies aimed at inhibiting the transcription, translation, processing or function of 98P4B6 as well as cancer vaccines. In one aspect, the invention provides compositions, and methods comprising them, for treating a cancer that expresses 98P4B6 in a human subject wherein the composition comprises a carrier suitable for human use and a human unit dose of one or more than one agent that inhibits the production or function of 98P4B6. Preferably, the carrier is a uniquely human carrier. In another aspect of the invention, the agent is a moiety that is immunoreactive with 98P4B6 protein. Non-limiting examples of such moieties include, but are not limited to, antibodies (such as single chain, monoclonal, polyclonal, humanized, chimeric, or human antibodies), functional equivalents thereof (whether naturally occurring or synthetic), and combinations thereof. The antibodies can be conjugated to a diagnostic or therapeutic moiety. In another aspect, the agent is a small molecule as defined herein.

In another aspect, the agent comprises one or more than one peptide which comprises a cytotoxic T lymphocyte (CTL) epitope that binds an HLA class I molecule in a human to elicit a CTL response to 98P4B6 and/or one or more than one peptide which comprises a helper T lymphocyte (HTL) epitope which binds an HLA class II molecule in a human to elicit an HTL response. The peptides of the invention may be on the same or on one or more separate polypeptide molecules. In a further aspect of the invention, the agent comprises one or more than one nucleic acid molecule that expresses one or more than one of the CTL or HTL response stimulating peptides as described above. In yet another aspect of the invention, the one or more than one nucleic acid molecule may express a moiety that is immunologically reactive with 98P4B6 as described above. The one or more than one nucleic acid molecule may also be, or encodes, a molecule that inhibits production of 98P4B6. Non-limiting examples of such molecules include, but are not limited to, those complementary to a nucleotide sequence essential for production of 98P4B6 (e.g. antisense sequences or molecules that form a triple helix with a nucleotide double helix essential for 98P4B6 production) or a ribozyme effective to lyse 98P4B6 mRNA.

Note that to determine the starting position of any peptide set forth in Tables VIII-XXI and XXII to XLIX (collectively HLA Peptide Tables) respective to its parental protein, e.g., variant 1, variant 2, etc., reference is made to three factors: the particular variant, the length of the peptide in an HLA Peptide Table, and the Search Peptides in Table VII. Generally, a unique Search Peptide is used to obtain HLA peptides of a particular for a particular variant. The position of each Search Peptide relative to its respective parent molecule is listed in Table VII. Accordingly, if a Search Peptide begins at position "X", one must add the value "X−1" to each position in Tables VIII-XXI and XXII to XLIX to obtain the actual position of the HLA peptides in their parental molecule. For example, if a particular Search Peptide begins at position 150 of its parental molecule, one must add 150−1, i.e., 149 to each HLA peptide amino acid position to calculate the position of that amino acid in the parent molecule.

One embodiment of the invention comprises an HLA peptide, that occurs at least twice in Tables VIII-XXI and XXII to XLIX collectively, or an oligonucleotide that encodes the HLA peptide. Another embodiment of the invention comprises an HLA peptide that occurs at least once in Tables VIII-XXI and at least once in tables XXII to XLIX, or an oligonucleotide that encodes the HLA peptide.

Another embodiment of the invention is antibody epitopes, which comprise a peptide regions, or an oligonucleotide encoding the peptide region, that has one two, three, four, or five of the following characteristics:

i) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Hydrophilicity profile of FIG. 5;

ii) a peptide region of at least 5 amino acids of a particular peptide of FIG. 3, in any whole number increment up to the full length of that protein in FIG. 3, that includes an amino acid position having a value equal to or less than 0.5, 0.4, 0.3, 0.2, 0.1, or having a value equal to 0.0, in the Hydropathicity profile of FIG. 6;

iii) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Percent Accessible Residues profile of FIG. 7;

iv) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Average Flexibility profile of FIG. 8; or v) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Beta-turn profile of FIG. 9.

BRIEF DESCRIPTION OF THE FIGURES

FIG. 1. The 98P4B6 SSH sequence of 183 nucleotides.

FIG. 2. A) The cDNA and amino acid sequence of 98P4B6 variant 1 (also called "98P4B6 v.1" or "98P4B6 variant 1") is shown in FIG. 2A. The start methionine is underlined. The open reading frame extends from nucleic acid 355-1719 including the stop codon.

B) The cDNA and amino acid sequence of 98P4B6 variant 2 (also called "98P4B6 v.2") is shown in FIG. 2B. The codon for the start methionine is underlined. The open reading frame extends from nucleic acid 4-138 including the stop codon.

C) The cDNA and amino acid sequence of 98P4B6 variant 3 (also called "98P4B6 v.3") is shown in FIG. 2C. The codon for the start methionine is underlined. The open reading frame extends from nucleic acid 188-1552 including the stop codon.

D) The cDNA and amino acid sequence of 98P4B6 variant 4 (also called "98P4B6 v.4") is shown in FIG. 2D. The codon for the start methionine is underlined. The open reading frame extends from nucleic acid 318-1682 including the stop codon.

E) The cDNA and amino acid sequence of 98P4B6 variant 5 (also called "98P4B6 v.5") is shown in FIG. 2E. The codon for the start methionine is underlined. The open reading frame extends from nucleic acid 318-1577 including the stop codon.

F) The cDNA and amino acid sequence of 98P4B6 variant 6 (also called "98P4B6 v.6") is shown in FIG. 2F. The codon for the start methionine is underlined. The open reading frame extends from nucleic acid 318-1790 including the stop codon.

G) The cDNA and amino acid sequence of 98P4B6 variant 7 (also called "98P4B6 v.7") is shown in FIG. 2G. The codon for the start methionine is underlined. The open reading frame extends from nucleic acid 295-2025 including the stop codon.

H) The cDNA and amino acid sequence of 98P4B6 variant 8 (also called "98P4B6 v.8") is shown in FIG. 2H. The codon for the start methionine is underlined. The open reading frame extends from nucleic acid 394-1866 including the stop codon.

I) The cDNA and amino acid sequence of 98P4B6 variant 9 (also called "98P4B6 v.9") is shown in FIG. 2I. The codon for the start methionine is underlined. The open reading frame extends from nucleic acid 355-1719 including the stop codon.

J) The cDNA and amino acid sequence of 98P4B6 variant 10 (also called "98P4B6 v.10") is shown in FIG. 2J. The codon for the start methionine is underlined. The open reading frame extends from nucleic acid 355-1719 including the stop codon.

K) The cDNA and amino acid sequence of 98P4B6 variant 11 (also called "98P4B6 v.11") is shown in FIG. 2K. The codon for the start methionine is underlined. The open reading frame extends from nucleic acid 355-1719 including the stop codon.

L) The cDNA and amino acid sequence of 98P4B6 variant 12 (also called "98P4B6 v.12") is shown in FIG. 2L. The codon for the start methionine is underlined. The open reading frame extends from nucleic acid 355-1719 including the stop codon.

M) The cDNA and amino acid sequence of 98P4B6 variant 13 (also called "98P4B6 v.13") is shown in FIG. 2M. The codon for the start methionine is underlined. The open reading frame extends from nucleic acid 355-1719 including the stop codon.

N) The cDNA and amino acid sequence of 98P4B6 variant 14 (also called "98P4B6 v.14") is shown in FIG. 2N. The codon for the start methionine is underlined. The open reading frame extends from nucleic acid 355-1719 including the stop codon.

O) The cDNA and amino acid sequence of 98P4B6 variant 15 (also called "98P4B6 v.15") is shown in FIG. 2O. The codon for the start methionine is underlined. The open reading frame extends from nucleic acid 355-1719 including the stop codon.

P) The cDNA and amino acid sequence of 98P4B6 variant 16 (also called "98P4B6 v.16") is shown in FIG. 2P. The codon for the start methionine is underlined. The open reading frame extends from nucleic acid 355-1719 including the stop codon.

Q) The cDNA and amino acid sequence of 98P4B6 variant 17 (also called "98P4B6 v.17") is shown in FIG. 2Q. The codon for the start methionine is underlined. The open reading frame extends from nucleic acid 355-1719 including the stop codon.

R) The cDNA and amino acid sequence of 98P4B6 variant 18 (also called "98P4B6 v.18") is shown in FIG. 2R. The codon for the start methionine is underlined. The open reading frame extends from nucleic acid 355-1719 including the stop codon.

S) The cDNA and amino acid sequence of 98P4B6 variant 19 (also called "98P4B6 v.19") is shown in FIG. 2S. The codon for the start methionine is underlined. The open reading frame extends from nucleic acid 355-1719 including the stop codon.

T) The cDNA and amino acid sequence of 98P4B6 variant 20 (also called "98P4B6 v.20") is shown in FIG. 2T. The codon for the start methionine is underlined. The open reading frame extends from nucleic acid 295-2025 including the stop codon.

U) The cDNA and amino acid sequence of 98P4B6 variant 21 (also called "98P4B6 v.21") is shown in FIG. 2U. The codon for the start methionine is underlined. The open reading frame extends from nucleic acid 295-2025 including the stop codon.

V) The cDNA and amino acid sequence of 98P4B6 variant 22 (also called "98P4B6 v.22") is shown in FIG. 2V. The codon for the start methionine is underlined. The open reading frame extends from nucleic acid 295-2025 including the stop codon.

W) The cDNA and amino acid sequence of 98P4B6 variant 23 (also called "98P4B6 v.23") is shown in FIG. 2W. The codon for the start methionine is underlined. The open reading frame extends from nucleic acid 295-2025 including the stop codon.

X) The cDNA and amino acid sequence of 98P4B6 variant 24 (also called "98P4B6 v.24") is shown in FIG. 2X. The codon for the start methionine is underlined. The open reading frame extends from nucleic acid 295-2025 including the stop codon.

Y) The cDNA and amino acid sequence of 98P4B6 variant 25 (also called "98P4B6 v.25") is shown in FIG. 2Y. The codon for the start methionine is underlined. The open reading frame extends from nucleic acid 394-1866 including the stop codon.

Z) The cDNA and amino acid sequence of 98P4B6 variant 26 (also called "98P4B6 v.26") is shown in FIG. 2Z. The codon for the start methionine is underlined. The open reading frame extends from nucleic acid 394-1866 including the stop codon.

AA) The cDNA and amino acid sequence of 98P4B6 variant 27 (also called "98P4B6 v.27") is shown in FIG. 2AA. The codon for the start methionine is underlined. The open reading frame extends from nucleic acid 394-1866 including the stop codon.

AB) The cDNA and amino acid sequence of 98P4B6 variant 28 (also called "98P4B6 v.28") is shown in FIG. 2AB. The codon for the start methionine is underlined. The open reading frame extends from nucleic acid 394-1866 including the stop codon.

AC) The cDNA and amino acid sequence of 98P4B6 variant 29 (also called "98P4B6 v.29") is shown in FIG. 2AC. The codon for the start methionine is underlined. The open reading frame extends from nucleic acid 394-1866 including the stop codon.

AD) The cDNA and amino acid sequence of 98P4B6 variant 30 (also called "98P4B6 v.30") is shown in FIG. 2AD. The codon for the start methionine is underlined. The open reading frame extends from nucleic acid 394-1866 including the stop codon.

AE) The cDNA and amino acid sequence of 98P4B6 variant 31 (also called "98P4B6 v.31") is shown in FIG. 2AE. The codon for the start methionine is underlined. The open reading frame extends from nucleic acid 394-1866 including the stop codon.

AF) The cDNA and amino acid sequence of 98P4B6 variant 32 (also called "98P4B6 v.32") is shown in FIG. 2AF. The codon for the start methionine is underlined. The open reading frame extends from nucleic acid 394-1866 including the stop codon.

AG) The cDNA and amino acid sequence of 98P4B6 variant 33 (also called "98P4B6 v.33") is shown in FIG. 2AG. The codon for the start methionine is underlined. The open reading frame extends from nucleic acid 394-1866 including the stop codon.

AH) The cDNA and amino acid sequence of 98P4B6 variant 34 (also called "98P4B6 v.34") is shown in FIG. 2AH. The codon for the start methionine is underlined. The open reading frame extends from nucleic acid 394-1866 including the stop codon.

AI) The cDNA and amino acid sequence of 98P4B6 variant 35 (also called "98P4B6 v.35") is shown in FIG. 2AI. The codon for the start methionine is underlined. The open reading frame extends from nucleic acid 394-1866 including the stop codon.

AJ) The cDNA and amino acid sequence of 98P4B6 variant 36 (also called "98P4B6 v.36") is shown in FIG. 2AJ. The codon for the start methionine is underlined. The open reading frame extends from nucleic acid 394-1866 including the stop codon.

AK) The cDNA and amino acid sequence of 98P4B6 variant 37 (also called "98P4B6 v.37") is shown in FIG. 2AK. The codon for the start methionine is underlined. The open reading frame extends from nucleic acid 394-1866 including the stop codon.

AL) The cDNA and amino acid sequence of 98P4B6 variant 38 (also called "98P4B6 v.38") is shown in FIG. 2AL. The codon for the start methionine is underlined. The open reading frame extends from nucleic acid 394-1866 including the stop codon.

FIG. 3.

A) The amino acid sequence of 98P4B6 v.1 is shown in FIG. 3A; it has 454 amino acids.

B) The amino acid sequence of 98P4B6 v.2 is shown in FIG. 3B; it has 45 amino acids.

C) The amino acid sequence of 98P4B6 v.5 is shown in FIG. 3C; it has 419 amino acids.

D) The amino acid sequence of 98P4B6 v.6 is shown in FIG. 3D; it has 490 amino acids.

E) The amino acid sequence of 98P4B6 v.7 is shown in FIG. 3E; it has 576 amino acids.

F) The amino acid sequence of 98P4B6 v.8 is shown in FIG. 3F; it has 490 amino acids.

G) The amino acid sequence of 98P4B6 v.13 is shown in FIG. 3G; it has 454 amino acids.

H) The amino acid sequence of 98P4B6 v.14 is shown in FIG. 3H; it has 454 amino acids.

I) The amino acid sequence of 98P4B6 v.21 is shown in FIG. 3I; it has 576 amino acids.

J) The amino acid sequence of 98P4B6 v.25 is shown in FIG. 3J; it has 490 amino acids.

As used herein, a reference to 98P4B6 includes all variants thereof, including those shown in FIGS. 2, 3, 10, and 11, unless the context clearly indicates otherwise.

FIG. 4. Comparison of 98P4B6 with known genes: Human STAMP1, human six transmembrane epithelial antigen of prostate 2 and mouse six transmembrane epithelial antigen of prostate 2.

FIG. 4(A) Alignment of 98P4B6 variant 1 to human STAMP1 (gi 15418732).

FIG. 4(B) Alignment of 98P4B6 variant 1 with human STEAP2 (gi:23308593).

FIG. 4(C) Alignment of 98P4B6 variant 1 with mouse STEAP2 (gi 28501136).

FIG. 4(D): Clustal Alignment of the three 98P4B6 variants, depicting that 98P4B6 V1 B (SEQ ID NO: 94) contains an additional 62 aa at its N-terminus relative to V1 (SEQ ID NO: 95), and that 98P4B6 V2 (SEQ ID NO: 96) carries a I to T point mutation at aa 225 relative to V1.

DETAILED DESCRIPTION OF THE INVENTION

Outline of Sections

I.) Definitions
II.) 98P4B6 Polynucleotides
   II.A.) Uses of 98P4B6 Polynucleotides
      II.A.1.) Monitoring of Genetic Abnormalities
      II.A.2.) Antisense Embodiments
      II.A.3.) Primers and Primer Pairs II.A.4.) Isolation of 98P4B6-Encoding Nucleic Acid Molecules
II.A.5.) Recombinant Nucleic Acid Molecules and Host-Vector Systems
III.) 98P4B6-Related Proteins
　III.A.) Motif-bearing Protein Embodiments
　III.B.) Expression of 98P4B6-Related Proteins
　III.C.) Modifications of 98P4B6-Related Proteins
　III.D.) Uses of 98P4B6-Related Proteins
IV.) 98P4B6 Antibodies
V.) 98P4B6 Cellular Immune Responses
VI.) 98P4B6 Transgenic Animals
VII.) Methods for the Detection of 98P4B6
VIII.) Methods for Monitoring the Status of 98P4B6-Related Genes and Their Products
IX.) Identification of Molecules That Interact With 98P4B6
X.) Therapeutic Methods and Compositions
　X.A.) Anti-Cancer Vaccines
　X.B.) 98P4B6 as a Target for Antibody-Based Therapy
　X.C.) 98P4B6 as a Target for Cellular Immune Responses
　　X.C.1. Minigene Vaccines
　　X.C.2. Combinations of CTL Peptides with Helper Peptides
　　X.C.3. Combinations of CTL Peptides with T Cell Priming Agents
　　X.C.4. Vaccine Compositions Comprising DC Pulsed with CTL and/or HTL Peptides
　X.D.) Adoptive Immunotherapy
　X.E.) Administration of Vaccines for Therapeutic or Prophylactic Purposes
XI.) Diagnostic and Prognostic Embodiments of 98P4B6.
XII.) Inhibition of 98P4B6 Protein Function
　XII.A.) Inhibition of 98P4B6 With Intracellular Antibodies
　XII.B.) Inhibition of 98P4B6 with Recombinant Proteins
　XII.C.) Inhibition of 98P4B6 Transcription or Translation
　XII.D.) General Considerations for Therapeutic Strategies
XIII.) Identification, Characterization and Use of Modulators of 98P4B6
XIV.) KITS/Articles of Manufacture
I.) Definitions:

Unless otherwise defined, all terms of art, notations and other scientific terms or terminology used herein are intended to have the meanings commonly understood by those of skill in the art to which this invention pertains. In some cases, terms with commonly understood meanings are defined herein for clarity and/or for ready reference, and the inclusion of such definitions herein should not necessarily be construed to represent a substantial difference over what is generally understood in the art. Many of the techniques and procedures described or referenced herein are well understood and commonly employed using conventional methodology by those skilled in the art, such as, for example, the widely utilized molecular cloning methodologies described in Sambrook et al., Molecular Cloning: A Laboratory Manual 2nd. edition (1989) Cold Spring Harbor Laboratory Press, Cold Spring Harbor, N.Y. As appropriate, procedures involving the use of commercially available kits and reagents are generally carried out in accordance with manufacturer defined protocols and/or parameters unless otherwise noted.

The terms "advanced prostate cancer", "locally advanced prostate cancer", "advanced disease" and "locally advanced disease" mean prostate cancers that have extended through the prostate capsule, and are meant to include stage C disease under the American Urological Association (AUA) system, stage C1-C2 disease under the Whitmore-Jewett system, and stage T3-T4 and N+ disease under the TNM (tumor, node, metastasis) system. In general, surgery is not recommended for patients with locally advanced disease, and these patients have substantially less favorable outcomes compared to patients having clinically localized (organ-confined) prostate cancer. Locally advanced disease is clinically identified by palpable evidence of induration beyond the lateral border of the prostate, or asymmetry or induration above the prostate base. Locally advanced prostate cancer is presently diagnosed pathologically following radical prostatectomy if the tumor invades or penetrates the prostatic capsule, extends into the surgical margin, or invades the seminal vesicles.

"Altering the native glycosylation pattern" is intended for purposes herein to mean deleting one or more carbohydrate moieties found in native sequence 98P4B6 (either by removing the underlying glycosylation site or by deleting the glycosylation by chemical and/or enzymatic means), and/or adding one or more glycosylation sites that are not present in the native sequence 98P4B6. In addition, the phrase includes qualitative changes in the glycosylation of the native proteins, involving a change in the nature and proportions of the various carbohydrate moieties present.

The term "analog" refers to a molecule which is structurally similar or shares similar or corresponding attributes with another molecule (e.g. a 98P4B6-related protein). For example, an analog of a 98P4B6 protein can be specifically bound by an antibody or T cell that specifically binds to 98P4B6.

The term "antibody" is used in the broadest sense. Therefore, an "antibody" can be naturally occurring or man-made such as monoclonal antibodies produced by conventional hybridoma technology. Anti-98P4B6 antibodies comprise monoclonal and polyclonal antibodies as well as fragments containing the antigen-binding domain and/or one or more complementarity determining regions of these antibodies.

An "antibody fragment" is defined as at least a portion of the variable region of the immunoglobulin molecule that binds to its target, i.e., the antigen-binding region. In one embodiment it specifically covers single anti-98P4B6 antibodies and clones thereof (including agonist, antagonist and neutralizing antibodies) and anti-98P4B6 antibody compositions with polyepitopic specificity.

The term "codon optimized sequences" refers to nucleotide sequences that have been optimized for a particular host species by replacing any codons having a usage frequency of less than about 20%. Nucleotide sequences that have been optimized for expression in a given host species by elimination of spurious polyadenylation sequences, elimination of exon/intron splicing signals, elimination of transposon-like repeats and/or optimization of GC content in addition to codon optimization are referred to herein as an "expression enhanced sequences."

A "combinatorial library" is a collection of diverse chemical compounds generated by either chemical synthesis or biological synthesis by combining a number of chemical "building blocks" such as reagents. For example, a linear combinatorial chemical library, such as a polypeptide (e.g., mutein) library, is formed by combining a set of chemical building blocks called amino acids in every possible way for a given compound length (i.e., the number of amino acids in a polypeptide compound). Numerous chemical compounds are synthesized through such combinatorial mixing of chemical building blocks (Gallop et al., J. Med. Chem. 37(9): 1233-1251 (1994)).

Preparation and screening of combinatorial libraries is well known to those of skill in the art. Such combinatorial chemical libraries include, but are not limited to, peptide libraries (see, e.g., U.S. Pat. No. 5,010,175, Furka, Pept. Prot. Res. 37:487-493 (1991), Houghton et al., Nature, 354:84-88 (1991)), peptoids (PCT Publication No WO 91/19735), encoded peptides (PCT Publication WO 93/20242), random bio-oligomers (PCT Publication WO 92/00091), benzodiazepines (U.S. Pat. No. 5,288,514), diversomers such as hydantoins, benzodiazepines and dipeptides (Hobbs et al., Proc. Nat. Acad. Sci. USA 90:6909-6913 (1993)), vinylogous polypeptides (Hagihara et al., J. Amer. Chem. Soc. 114:6568 (1992)), nonpeptidal peptidomimetics with a Beta-D-Glucose scaffolding (Hirschmann et al., J. Amer. Chem. Soc. 114:9217-9218 (1992)), analogous organic syntheses of small compound libraries (Chen et al., J. Amer. Chem. Soc. 116:2661 (1994)), oligocarbarmates (Cho, et al., Science 261:1303 (1993)), and/or peptidyl phosphonates (Campbell et al., J. Org. Chem. 59:658 (1994)). See, generally, Gordon et al., J. Med. Chem. 37:1385 (1994), nucleic acid libraries (see, e.g., Stratagene, Corp.), peptide nucleic acid libraries (see, e.g., U.S. Pat. No. 5,539,083), antibody libraries (see, e.g., Vaughn et al., Nature Biotechnology 14(3): 309-314 (1996), and PCT/US96/10287), carbohydrate libraries (see, e.g., Liang et al., Science 274:1520-1522 (1996), and U.S. Pat. No. 5,593,853), and small organic molecule libraries (see, e.g., benzodiazepines, Baum, C&EN, January 18, page 33 (1993); isoprenoids, U.S. Pat. No. 5,569,588; thiazolidinones and metathiazanones, U.S. Pat. No. 5,549,974; pyrrolidines, U.S. Pat. Nos. 5,525,735 and 5,519,134; morpholino compounds, U.S. Pat. No. 5,506, 337; benzodiazepines, U.S. Pat. No. 5,288,514; and the like).

Devices for the preparation of combinatorial libraries are commercially available (see, e.g., 357 NIPS, 390 NIPS, Advanced Chem Tech, Louisville Ky.; Symphony, Rainin, Woburn, Mass.; 433A, Applied Biosystems, Foster City, Calif.; 9050, Plus, Millipore, Bedford, NIA). A number of well-known robotic systems have also been developed for solution phase chemistries. These systems include automated workstations such as the automated synthesis apparatus developed by Takeda Chemical Industries, LTD. (Osaka, Japan) and many robotic systems utilizing robotic arms (Zymate H, Zymark Corporation, Hopkinton, Mass.; Orca, Hewlett-Packard, Palo Alto, Calif.), which mimic the manual synthetic operations performed by a chemist. Any of the above devices are suitable for use with the present invention. The nature and implementation of modifications to these devices (if any) so that they can operate as discussed herein will be apparent to persons skilled in the relevant art. In addition, numerous combinatorial libraries are themselves commercially available (see, e.g., ComGenex, Princeton, N.J.; Asinex, Moscow, RU; Tripos, Inc., St. Louis, Mo.; ChemStar, Ltd, Moscow, RU; 3D Pharmaceuticals, Exton, Pa.; Martek Biosciences, Columbia, Md.; etc.).

The term "cytotoxic agent" refers to a substance that inhibits or prevents the expression activity of cells, function of cells and/or causes destruction of cells. The term is intended to include radioactive isotopes chemotherapeutic agents, and toxins such as small molecule toxins or enzymatically active toxins of bacterial, fungal, plant or animal origin, including fragments and/or variants thereof. Examples of cytotoxic agents include, but are not limited to auristatins, auromycins, maytansinoids, yttrium, bismuth, ricin, ricin A-chain, combrestatin, duocarmycins, dolostatins, doxorubicin, daunorubicin, taxol, cisplatin, cc1065, ethidium bromide, mitomycin, etoposide, tenoposide, vincristine, vinblastine, colchicine, dihydroxy anthracin dione, actinomycin, diphtheria toxin, Pseudomonas exotoxin (PE) A, PE40, abrin, abrin A chain, modeccin A chain, alpha-sarcin, gelonin, mitogellin, retstrictocin, phenomycin, enomycin, curicin, crotin, calicheamicin, *Sapaonaria officinalis* inhibitor, and glucocorticoid and other chemotherapeutic agents, as well as radioisotopes such as $At^{211}, I^{131}, I^{125}, Y^{90}, Re^{186}, Re^{188}, Sm^{153}, Bi^{212\, or\, 213}, P^{32}$ and radioactive isotopes of Lu including $Lu^{177}$. Antibodies may also be conjugated to an anti-cancer pro-drug activating enzyme capable of converting the pro-drug to its active form.

The "gene product" is sometimes referred to herein as a protein or mRNA. For example, a "gene product of the invention" is sometimes referred to herein as a "cancer amino acid sequence", "cancer protein", "protein of a cancer listed in Table I", a "cancer mRNA", "mRNA of a cancer listed in Table I", etc. In one embodiment, the cancer protein is encoded by a nucleic acid of FIG. 2. The cancer protein can be a fragment, or alternatively, be the full-length protein to the fragment encoded by the nucleic acids of FIG. 2. In one embodiment, a cancer amino acid sequence is used to determine sequence identity or similarity. In another embodiment, the sequences are naturally occurring allelic variants of a protein encoded by a nucleic acid of FIG. 2. In another embodiment, the sequences are sequence variants as further described herein.

"High throughput screening" assays for the presence, absence, quantification, or other properties of particular nucleic acids or protein products are well known to those of skill in the art. Similarly, binding assays and reporter gene assays are similarly well known. Thus, e.g., U.S. Pat. No. 5,559,410 discloses high throughput screening methods for proteins; U.S. Pat. No. 5,585,639 discloses high throughput screening methods for nucleic acid binding (i.e., in arrays); while U.S. Pat. Nos. 5,576,220 and 5,541,061 disclose high throughput methods of screening for ligand/antibody binding.

In addition, high throughput screening systems are commercially available (see, e.g., Amersham Biosciences, Piscataway, N.J.; Zymark Corp., Hopkinton, Mass.; Air Technical Industries, Mentor, Ohio; Beckman Instruments, Inc. Fullerton, Calif.; Precision Systems, Inc., Natick, Mass.; etc.). These systems typically automate entire procedures, including all sample and reagent pipetting, liquid dispensing, timed incubations, and final readings of the microplate in detector(s) appropriate for the assay. These configurable systems provide high throughput and rapid start up as well as a high degree of flexibility and customization. The manufacturers of such systems provide detailed protocols for various high throughput systems. Thus, e.g., Zymark Corp. provides technical bulletins describing screening systems for detecting the modulation of gene transcription, ligand binding, and the like.

The term "homolog" refers to a molecule which exhibits homology to another molecule, by for example, having sequences of chemical residues that are the same or similar at corresponding positions.

"Human Leukocyte Antigen" or "HLA" is a human class I or class II Major Histocompatibility Complex (MHC) protein (see, e.g., Stites, et al., IMMUNOLOGY, $8^{TH}$ ED., Lange Publishing, Los Altos, Calif. (1994).

The terms "hybridize", "hybridizing", "hybridizes" and the like, used in the context of polynucleotides, are meant to refer to conventional hybridization conditions, preferably such as hybridization in 50% formamide/6×SSC/0.1% SDS/100 μg/ml ssDNA, in which temperatures for hybridization are above 37 degrees C. and temperatures for washing in 0.1×SSC/0.1% SDS are above 55 degrees C.

The phrases "isolated" or "biologically pure" refer to material which is substantially or essentially free from components which normally accompany the material as it is found in its native state. Thus, isolated peptides in accordance with the invention preferably do not contain materials normally associated with the peptides in their in situ environment. For example, a polynucleotide is said to be "isolated" when it is substantially separated from contaminant polynucleotides that correspond or are complementary to genes other than the 98P4B6 genes or that encode polypeptides other than 98P4B6 gene product or fragments thereof. A skilled artisan can readily employ nucleic acid isolation procedures to obtain an isolated 98P4B6 polynucleotide. A protein is said to be "isolated," for example, when physical, mechanical or chemical methods are employed to remove the 98P4B6 proteins from cellular constituents that are normally associated with the protein. A skilled artisan can readily employ standard purification methods to obtain an isolated 98P4B6 protein. Alternatively, an isolated protein can be prepared by chemical means.

The term "mammal" refers to any organism classified as a mammal, including mice, rats, rabbits, dogs, cats, cows, horses and humans. In one embodiment of the invention, the mammal is a mouse. In another embodiment of the invention, the mammal is a human.

The terms "metastatic prostate cancer" and "metastatic disease" mean prostate cancers that have spread to regional lymph nodes or to distant sites, and are meant to include stage D disease under the AUA system and stage T×N×M+ under the TNM system. As is the case with locally advanced prostate cancer, surgery is generally not indicated for patients with metastatic disease, and hormonal (androgen ablation) therapy is a preferred treatment modality. Patients with metastatic prostate cancer eventually develop an androgen-refractory state within 12 to 18 months of treatment initiation. Approximately half of these androgen-refractory patients die within 6 months after developing that status. The most common site for prostate cancer metastasis is bone. Prostate cancer bone metastases are often osteoblastic rather than osteolytic (i.e., resulting in net bone formation). Bone metastases are found most frequently in the spine, followed by the femur, pelvis, rib cage, skull and humerus. Other common sites for metastasis include lymph nodes, lung, liver and brain. Metastatic prostate cancer is typically diagnosed by open or laparoscopic pelvic lymphadenectomy, whole body radionuclide scans, skeletal radiography, and/or bone lesion biopsy.

The term "modulator" or "test compound" or "drug candidate" or grammatical equivalents as used herein describe any molecule, e.g., protein, oligopeptide, small organic molecule, polysaccharide, polynucleotide, etc., to be tested for the capacity to directly or indirectly alter the cancer phenotype or the expression of a cancer sequence, e.g., a nucleic acid or protein sequences, or effects of cancer sequences (e.g., signaling, gene expression, protein interaction, etc.) In one aspect, a modulator will neutralize the effect of a cancer protein of the invention. By "neutralize" is meant that an activity of a protein is inhibited or blocked, along with the consequent effect on the cell. In another aspect, a modulator will neutralize the effect of a gene, and its corresponding protein, of the invention by normalizing levels of said protein. In preferred embodiments, modulators alter expression profiles, or expression profile nucleic acids or proteins provided herein, or downstream effector pathways. In one embodiment, the modulator suppresses a cancer phenotype, e.g. to a normal tissue fingerprint. In another embodiment, a modulator induced a cancer phenotype. Generally, a plurality of assay mixtures is run in parallel with different agent concentrations to obtain a differential response to the various concentrations. Typically, one of these concentrations serves as a negative control, i.e., at zero concentration or below the level of detection.

Modulators, drug candidates or test compounds encompass numerous chemical classes, though typically they are organic molecules, preferably small organic compounds having a molecular weight of more than 100 and less than about 2,500 Daltons. Preferred small molecules are less than 2000, or less than 1500 or less than 1000 or less than 500 D. Candidate agents comprise functional groups necessary for structural interaction with proteins, particularly hydrogen bonding, and typically include at least an amine, carbonyl, hydroxyl or carboxyl group, preferably at least two of the functional chemical groups. The candidate agents often comprise cyclical carbon or heterocyclic structures and/or aromatic or polyaromatic structures substituted with one or more of the above functional groups. Modulators also comprise biomolecules such as peptides, saccharides, fatty acids, steroids, purines, pyrimidines, derivatives, structural analogs or combinations thereof. Particularly preferred are peptides. One class of modulators are peptides, for example of from about five to about 35 amino acids, with from about five to about 20 amino acids being preferred, and from about 7 to about 15 being particularly preferred. Preferably, the cancer modulatory protein is soluble, includes a non-transmembrane region, and/or, has an N-terminal Cys to aid in solubility. In one embodiment, the C-terminus of the fragment is kept as a free acid and the N-terminus is a free amine to aid in coupling, i.e., to cysteine. In one embodiment, a cancer protein of the invention is conjugated to an immunogenic agent as discussed herein. In one embodiment, the cancer protein is conjugated to BSA. The peptides of the invention, e.g., of preferred lengths, can be linked to each other or to other amino acids to create a longer peptide/protein. The modulatory peptides can be digests of naturally occurring proteins as is outlined above, random peptides, or "biased" random peptides. In a preferred embodiment, peptide/protein-based modulators are antibodies, and fragments thereof, as defined herein.

Modulators of cancer can also be nucleic acids. Nucleic acid modulating agents can be naturally occurring nucleic acids, random nucleic acids, or "biased" random nucleic acids. For example, digests of prokaryotic or eukaryotic genomes can be used in an approach analogous to that outlined above for proteins.

The term "monoclonal antibody" refers to an antibody obtained from a population of substantially homogeneous antibodies, i.e., the antibodies comprising the population are identical except for possible naturally occurring mutations that are present in minor amounts.

A "motif", as in biological motif of a 98P4B6-related protein, refers to any pattern of amino acids forming part of the primary sequence of a protein, that is associated with a particular function (e.g. protein-protein interaction, protein-DNA interaction, etc) or modification (e.g. that is phosphorylated, glycosylated or amidated), or localization (e.g. secretory sequence, nuclear localization sequence, etc.) or a sequence that is correlated with being immunogenic, either humorally or cellularly. A motif can be either contiguous or capable of being aligned to certain positions that are generally correlated with a certain function or property. In the context of HLA motifs, "motif" refers to the pattern of residues in a peptide of defined length, usually a peptide of from about 8 to about 13 amino acids for a class I HLA motif and from about 6 to about 25 amino acids for a class II HLA motif, which is recognized by a particular HLA molecule. Peptide motifs for HLA binding are typically different for each protein encoded by each human HLA allele and differ in the pattern of the primary and secondary anchor residues.

A "pharmaceutical excipient" comprises a material such as an adjuvant, a carrier, pH-adjusting and buffering agents, tonicity adjusting agents, wetting agents, preservative, and the like.

"Pharmaceutically acceptable" refers to a non-toxic, inert, and/or composition that is physiologically compatible with humans or other mammals.

The term "polynucleotide" means a polymeric form of nucleotides of at least 10 bases or base pairs in length, either ribonucleotides or deoxynucleotides or a modified form of either type of nucleotide, and is meant to include single and double stranded forms of DNA and/or RNA. In the art, this term if often used interchangeably with "oligonucleotide". A polynucleotide can comprise a nucleotide sequence disclosed herein wherein thymidine (T), as shown for example in FIG. 2, can also be uracil (U); this definition pertains to the differences between the chemical structures of DNA and RNA, in particular the observation that one of the four major bases in RNA is uracil (U) instead of thymidine (T).

The term "polypeptide" means a polymer of at least about 4, 5, 6, 7, or 8 amino acids. Throughout the specification, standard three letter or single letter designations for amino acids are used. In the art, this term is often used interchangeably with "peptide" or "protein".

An HLA "primary anchor residue" is an amino acid at a specific position along a peptide sequence which is understood to provide a contact point between the immunogenic peptide and the HLA molecule. One to three, usually two, primary anchor residues within a peptide of defined length generally defines a "motif" for an immunogenic peptide. These residues are understood to fit in close contact with peptide binding groove of an HLA molecule, with their side chains buried in specific pockets of the binding groove. In one embodiment, for example, the primary anchor residues for an HLA class I molecule are located at position 2 (from the amino terminal position) and at the carboxyl terminal position of a 8, 9, 10, 11, or 12 residue peptide epitope in accordance with the invention. Alternatively, in another embodiment, the primary anchor residues of a peptide binds an HLA class II molecule are spaced relative to each other, rather than to the termini of a peptide, where the peptide is generally of at least 9 amino acids in length. The primary anchor positions for each motif and supermotif are set forth in Table IV. For example, analog peptides can be created by altering the presence or absence of particular residues in the primary and/or secondary anchor positions shown in Table IV. Such analogs are used to modulate the binding affinity and/or population coverage of a peptide comprising a particular HLA motif or supermotif.

"Radioisotopes" include, but are not limited to the following (non-limiting exemplary uses are also set forth):

Examples Of Medical Isotopes

Isotope

Description of Use

Actinium-225
(AC-225)
See Thorium-229 (Th-229)

Actinium-227
(AC-227)
Parent of Radium-223 (Ra-223) which is an alpha emitter used to treat metastases in the skeleton resulting from cancer (i.e., breast and prostate cancers), and cancer radioimmunotherapy Bismuth-212
(Bi-212)
See Thorium-228 (Th-228)

Bismuth-213
(Bi-213)
See Thorium-229 (Th-229)

Cadmium-109
(Cd-109)
Cancer detection

Cobalt-60
(Co-60)
Radiation source for radiotherapy of cancer, for food irradiators, and for sterilization of medical supplies Copper-64
(Cu-64)
A positron emitter used for cancer therapy and SPECT imaging Copper-67
(Cu-67)
Beta/gamma emitter used in cancer radioimmunotherapy and diagnostic studies (i.e., breast and colon cancers, and lymphoma)

Dysprosium-166
(Dy-166)
Cancer radioimmunotherapy

Erbium-169
(Er-169)
Rheumatoid arthritis treatment, particularly for the small joints associated with fingers and toes Europium-152
(Eu-152)
Radiation source for food irradiation and for sterilization of medical supplies Europium-154
(Eu-154)
Radiation source for food irradiation and for sterilization of medical supplies Gadolinium-153
(Gd-153)
Osteoporosis detection and nuclear medical quality assurance devices Gold-198
(Au-198)
Implant and intracavity therapy of ovarian, prostate, and brain cancers Holmium-166
(Ho-166)
Multiple myeloma treatment in targeted skeletal therapy, cancer radioimmunotherapy, bone marrow ablation, and rheumatoid arthritis treatment Iodine-125
(1-125)
Osteoporosis detection, diagnostic imaging, tracer drugs, brain cancer treatment, radiolabeling, tumor imaging, mapping of receptors in the brain, interstitial radiation therapy, brachytherapy for treatment of prostate cancer, determination of glomerular filtration rate (GFR), determination of plasma volume, detection of deep vein thrombosis of the legs Iodine-131
(I-131)
Thyroid function evaluation, thyroid disease detection, treatment of thyroid cancer as well as other non-malignant thyroid diseases (i.e., Graves disease, goiters, and hyperthyroidism), treatment of leukemia, lymphoma, and other forms of cancer (e.g., breast cancer) using radioimmunotherapy Iridium-192
(Ir-192)
Brachytherapy, brain and spinal cord tumor treatment, treatment of blocked arteries (i.e., arteriosclerosis and restenosis), and implants for breast and prostate tumors Lutetium-177
(Lu-177)
Cancer radioimmunotherapy and treatment of blocked arteries (i.e., arteriosclerosis and restenosis)

Molybdenum-99
(Mo-99)
Parent of Technetium-99m (Tc-99m) which is used for imaging the brain, liver, lungs, heart, and other organs. Currently, Tc-99m is the most widely used radioisotope used for diagnostic imaging of various cancers and diseases involving the brain, heart, liver, lungs; also used in detection of deep vein thrombosis of the legs Osmium-194
(Os-194)
Cancer radioimmunotherapy Palladium-103
(Pd-103)
Prostate cancer treatment Platinum-195m
(Pt-195m)
Studies on biodistribution and metabolism of cisplatin, a chemotherapeutic drug Phosphorus-32
(P-32)
Polycythemia rubra vera (blood cell disease) and leukemia treatment, bone cancer diagnosis/treatment; colon, pancreatic, and liver cancer treatment; radiolabeling nucleic acids for in vitro research, diagnosis of superficial tumors, treatment of blocked arteries (i.e., arteriosclerosis and restenosis), and intracavity therapy Phosphorus-33
(P-33)
Leukemia treatment, bone disease diagnosis/treatment, radiolabeling, and treatment of blocked arteries (i.e., arteriosclerosis and restenosis)

Radium-223
(Ra-223)
See Actinium-227 (Ac-227)

Rhenium-186
(Re-186)
Bone cancer pain relief, rheumatoid arthritis treatment, and diagnosis and treatment of lymphoma and bone, breast, colon, and liver cancers using radioimmunotherapy Rhenium-188
(Re-188)
Cancer diagnosis and treatment using radioimmunotherapy, bone cancer pain relief, treatment of rheumatoid arthritis, and treatment of prostate cancer Rhodium-105
(Rh-105)
Cancer radioimmunotherapy Samarium-145
(Sm-145)
Ocular cancer treatment Samarium-153
(Sm-153)
Cancer radioimmunotherapy and bone cancer pain relief Scandium-47
(Sc-47)
Cancer radioimmunotherapy and bone cancer pain relief Selenium-75
(Se-75)
Radiotracer used in brain studies, imaging of adrenal cortex by gamma-scintigraphy, lateral locations of steroid secreting tumors, pancreatic scanning, detection of hyperactive parathyroid glands, measure rate of bile acid loss from the endogenous pool Strontium-85
(Sr-85)
Bone cancer detection and brain scans Strontium-89
(Sr-89)
Bone cancer pain relief, multiple myeloma treatment, and osteoblastic therapy Technetium-99m
(Tc-99m)
See Molybdenum-99 (Mo-99)

Thorium-228
(Th-228)
Parent of Bismuth-212 (Bi-212) which is an alpha emitter used in cancer radioimmunotherapy Thorium-229
(Th-229)
Parent of Actinium-225 (Ac-225) and grandparent of Bismuth-213 (Bi-213) which are alpha emitters used in cancer radioimmunotherapy Thulium-170
(Tm-170)
Gamma source for blood irradiators, energy source for implanted medical devices Tin-117m
(Sn-1i17m)
Cancer immunotherapy and bone cancer pain relief Tungsten-188
(W-188)
Parent for Rhenium-188 (Re-188) which is used for cancer diagnostics/treatment, bone cancer pain relief, rheumatoid arthritis treatment, and treatment of blocked arteries (i.e., arteriosclerosis and restenosis)

Xenon-127
(Xe-127)
Neuroimaging of brain disorders, high resolution SPECT studies, pulmonary function tests, and cerebral blood flow studies Ytterbium-175
(Yb-175)
Cancer radioimmunotherapy Yttrium-90
(Y-90)
Microseeds obtained from irradiating Yttrium-89 (Y-89) for liver cancer treatment Yttrium-91
(Y-91)
A gamma-emitting label for Yttrium-90 (Y-90) which is used for cancer radioimmunotherapy (i.e., lymphoma, breast, colon, kidney, lung, ovarian, prostate, pancreatic, and inoperable liver cancers)

By "randomized" or grammatical equivalents as herein applied to nucleic acids and proteins is meant that each nucleic acid and peptide consists of essentially random nucleotides and amino acids, respectively. These random peptides (or nucleic acids, discussed herein) can incorporate any nucleotide or amino acid at any position. The synthetic process can be designed to generate randomized proteins or nucleic acids, to allow the formation of all or most of the possible combinations over the length of the sequence, thus forming a library of randomized candidate bioactive proteinaceous agents.

In one embodiment, a library is "fully randomized," with no sequence preferences or constants at any position. In another embodiment, the library is a "biased random" library. That is, some positions within the sequence either are held constant, or are selected from a limited number of possibilities. For example, the nucleotides or amino acid residues are randomized within a defined class, e.g., of hydrophobic amino acids, hydrophilic residues, sterically biased (either small or large) residues, towards the creation of nucleic acid binding domains, the creation of cysteines, for cross-linking, prolines for SH-3 domains, serines, threonines, tyrosines or histidines for phosphorylation sites, etc., or to purines, etc.

A "recombinant" DNA or RNA molecule is a DNA or RNA molecule that has been subjected to molecular manipulation in vitro.

Non-limiting examples of small molecules include compounds that bind or interact with 98P4B6, ligands including hormones, neuropeptides, chemokines, odorants, phospholipids, and functional equivalents thereof that bind and preferably inhibit 98P4B6 protein function. Such non-limiting small molecules preferably have a molecular weight of less than about 10 kDa, more preferably below about 9, about 8, about 7, about 6, about 5 or about 4 kDa. In certain embodiments, small molecules physically associate with, or bind, 98P4B6 protein; are not found in naturally occurring metabolic pathways; and/or are more soluble in aqueous than non-aqueous solutions "Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured nucleic acid sequences to reanneal when complementary strands are present in an environment below their melting temperature. The higher the degree of desired homology between the probe and hybridizable sequence, the higher the relative temperature that can be used. As a result, it follows that higher relative temperatures would tend to make the reaction conditions more stringent, while lower temperatures less so. For additional details and explanation of stringency of hybridization reactions, see Ausubel et al., Current Protocols in Molecular Biology, Wiley Interscience Publishers, (1995).

"Stringent conditions" or "high stringency conditions", as defined herein, are identified by, but not limited to, those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 µg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C. "Moderately stringent conditions" are described by, but not limited to, those in Sambrook et al., Molecular Cloning: A Laboratory Manual, New York: Cold Spring Harbor Press, 1989, and include the use of washing solution and hybridization conditions (e.g., temperature, ionic strength and %SDS) less stringent than those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5×Denhardt's solution, 10% dextran sulfate, and 20 mg/mL denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

An HLA "supermotif" is a peptide binding specificity shared by HLA molecules encoded by two or more HLA alleles. Overall phenotypic frequencies of HLA-supertypes in different ethnic populations are set forth in Table IV (F). The non-limiting constituents of various supetypes are as follows:

A2: A*0201, A*0202, A*0203, A*0204, A* 0205, A*0206, A*6802, A*6901, A*0207

A3: A3, A11, A31,A*3301, A*6801,A*0301, A*1101, A*3101

B7: B7, B*3501-03, B*51, B*5301, B*5401, B*5501, B*5502, B*5601, B*6701, B*7801, B*0702, B*5101, B*5602

B44: B*3701, B*4402, B*4403, B*60 (B*4001), B61 (B*4006)

A1: A*0102, A*2604, A*3601, A*4301, A*8001

A24: A*24, A*30, A*2403, A*2404, A*3002, A*3003

B27: B*1401-02, B*1503, B*1509, B*1510, B*1518, B*3801-02, B*3901, B*3902, B*3903-04, B*4801-02, B*7301, B*2701-08

B58: B*1516, B*1517, B*5701, B*5702, B58

B62: B*4601, B52, B*1501 (B62), B*1502 (B75), B*1513 (B77)

Calculated population coverage afforded by different HLA-supertype combinations are set forth in Table IV (G).

As used herein "to treat" or "therapeutic" and grammatically related terms, refer to any improvement of any consequence of disease, such as prolonged survival, less morbidity, and/or a lessening of side effects which are the byproducts of an alternative therapeutic modality; full eradication of disease is not required.

A "transgenic animal" (e.g., a mouse or rat) is an animal having cells that contain a transgene, which transgene was introduced into the animal or an ancestor of the animal at a prenatal, e.g., an embryonic stage. A "transgene" is a DNA that is integrated into the genome of a cell from which a transgenic animal develops.

As used herein, an HLA or cellular immune response "vaccine" is a composition that contains or encodes one or more peptides of the invention. There are numerous embodiments of such vaccines, such as a cocktail of one or more individual peptides; one or more peptides of the invention comprised by a polyepitopic peptide; or nucleic acids that encode such individual peptides or polypeptides, e.g., a minigene that encodes a polyepitopic peptide. The "one or more peptides" can include any whole unit integer from 1-150 or more, e.g., at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100, 105,110, 115, 120, 125, 130,135,140, 145, or 150 or more peptides of the invention. The peptides or polypeptides can optionally be modified, such as by lipidation, addition of targeting or other sequences. HLA class I peptides of the invention can be admixed with, or linked to, HLA class II peptides, to facilitate activation of both cytotoxic T lymphocytes and helper T lymphocytes. HLA vaccines can also comprise peptide-pulsed antigen presenting cells, e.g., dendritic cells.

The term "variant" refers to a molecule that exhibits a variation from a described type or norm, such as a protein that has one or more different amino add residues in the corresponding position(s) of a specifically described protein (e.g. the 98P4B6 protein shown in FIG. 2 or FIG. 3. An analog is an example of a variant protein. Splice isoforms and single nucleotides polymorphisms (SNPs) are further examples of variants.

The "98P4B6-related proteins" of the invention include those specifically identified herein, as well as allelic variants, conservative substitution variants, analogs and homologs that can be isolated/generated and characterized without undue experimentation following the methods outlined herein or readily available in the art. Fusion proteins that combine parts of different 98P4B6 proteins or fragments thereof, as well as fusion proteins of a 98P4B6 protein and a heterologous polypeptide are also included. Such 98P4B6 proteins are collectively referred to as the 98P4B6-related proteins, the proteins of the invention, or 98P4B6. The term "98P4B6-related protein" refers to a polypeptide fragment or a 98P4B6 protein sequence of 4, 5, 6, 7, 8, 9, 10, 11, 12, 13, 14, 15, 16, 17, 18, 19, 20, 21, 22, 23, 24, 25, or more than 25 amino acids; or, at least 30, 35, 40, 45, 50, 55, 60, 65, 70, 80, 85, 90, 95, 100, 105, 110, 115, 120, 125, 130, 135, 140, 145, 150, 155, 160, 165, 170, 175, 180, 185,190,195, 200, 225, 250, 275, 300, 325, 350, 375, 400, 425, 450, 475, 500, 525, 550, 575, or 576 or more amino acids.

II.) 98P4B6 Polynucleotides

One aspect of the invention provides polynucleotides corresponding or complementary to all or part of a 98P4B6 gene, mRNA, and/or coding sequence, preferably in isolated form, including polynucleotides encoding a 98P4B6-related protein and fragments thereof, DNA, RNA, DNA/RNA hybrid, and related molecules, polynucleotides or oligonucleotides complementary to a 98P4B6 gene or mRNA sequence or a part thereof, and polynucleotides or oligonucleotides that hybridize to a 98P4B6 gene, mRNA, or to a 98P4B6 encoding polynucleotide (collectively, "98P4B6 polynucleotides"). In all instances when referred to in this section, T can also be U in FIG. 2.

Embodiments of a 98P4B6 polynucleotide include: a 98P4B6 polynucleotide having the sequence shown in FIG. 2, the nucleotide sequence of 98P4B6 as shown in FIG. 2 wherein T is U; at least 10 contiguous nucleotides of a polynucleotide having the sequence as shown in FIG. 2; or, at least 10 contiguous nucleotides of a polynucleotide having the sequence as shown in FIG. 2 where T is U. For example, embodiments of 98P4B6 nucleotides comprise, without limitation:

(I) a polynucleotide comprising, consisting essentially of, or consisting of a sequence as shown in FIG. 2, wherein T can also be U;

(II) a polynucleotide comprising, consisting essentially of, or consisting of the sequence as shown in FIG. 2A, from nucleotide residue number 355 through nucleotide residue number 1719, including the stop codon, wherein T can also be U;

(III) a polynucleotide comprising, consisting essentially of, or consisting of the sequence as shown in FIG. 2B, from nucleotide residue number 4 through nucleotide residue number 138, including the stop codon, wherein T can also be U;

(IV) a polynucleotide comprising, consisting essentially of, or consisting of the sequence as shown in FIG. 2C, from nucleotide residue number 188 through nucleotide residue number 1552, including the a stop codon, wherein T can also be U;

(V) a polynucleotide comprising, consisting essentially of, or consisting of the sequence as shown in FIG. 2D, from nucleotide residue number 318 through nucleotide residue number 1682, including the stop codon, wherein T can also be U;

(VI) a polynucleotide comprising, consisting essentially of, or consisting of the sequence as shown in FIG. 2E, from nucleotide residue number 318 through nucleotide residue number 1577, including the stop codon, wherein T can also be U;

(VII) a polynucleotide comprising, consisting essentially of, or consisting of the sequence as shown in FIG. 2F, from nucleotide residue number 318 through nucleotide residue number 1790, including the stop codon, wherein T can also be U;

(VIII) a polynucleotide comprising, consisting essentially of, or consisting of the sequence as shown in FIG. 2G, from nucleotide residue number 295 through nucleotide residue number 2025, including the stop codon, wherein T can also be U;

(IX) a polynucleotide comprising, consisting essentially of, or consisting of the sequence as shown in FIG. 2H, from nucleotide residue number 394 through nucleotide residue number 1866, including the stop codon, wherein T can also be U;

(X) a polynucleotide comprising, consisting essentially of, or consisting of the sequence as shown in FIG. 2I, from nucleotide residue number 355 through nucleotide residue number 1719, including the stop codon, wherein T can also be U;

(XI) a polynucleotide comprising, consisting essentially of, or consisting of the sequence as shown in FIG. 2J, from nucleotide residue number 355 through nucleotide residue number 1719, including the stop codon, wherein T can also be U;

(XII) a polynucleotide comprising, consisting essentially of, or consisting of the sequence as shown in FIG. 2K, from nucleotide residue number 355 through nucleotide residue number 1719, including the stop codon, wherein T can also be U;

(XIII) a polynucleotide comprising, consisting essentially of, or consisting of the sequence as shown in FIG. 2L, from nucleotide residue number 355 through nucleotide residue number 1719, including the stop codon, wherein T can also be U;

(XIV) a polynucleotide comprising, consisting essentially of, or consisting of the sequence as shown in FIG. 2M, from nucleotide residue number 355 through nucleotide residue number 1719, including the stop codon, wherein T can also be U;

(XV) a polynucleotide comprising, consisting essentially of, or consisting of the sequence as shown in FIG. 2N, from nucleotide residue number 355 through nucleotide residue number 1719, including the stop codon, wherein T can also be U;

(XVI) a polynucleotide comprising, consisting essentially of, or consisting of the sequence as shown in FIG. 2O, from nucleotide residue number 355 through nucleotide residue number 1719, including the stop codon, wherein T can also be U;

(XVII) a polynucleotide comprising, consisting essentially of, or consisting of the sequence as shown in FIG. 2P, from nucleotide residue number 355 through nucleotide residue number 1719, including the stop codon, wherein T can also be U;

(XVIII) a polynucleotide comprising, consisting essentially of, or consisting of the sequence as shown in FIG. 2Q, from nucleotide residue number 355 through nucleotide residue number 1719, including the stop codon, wherein T can also be U;

(XIX) a polynucleotide comprising, consisting essentially of, or consisting of the sequence as shown in FIG. 2R, from nucleotide residue number 355 through nucleotide residue number 1719, including the stop codon, wherein T can also be U;

(XX) a polynucleotide comprising, consisting essentially of, or consisting of the sequence as shown in FIG. 2S, from nucleotide residue number 355 through nucleotide residue number 1719, including the stop codon, wherein T can also be U;

(XXI) a polynucleotide comprising, consisting essentially of, or consisting of the sequence as shown in FIG. 2T, from nucleotide residue number 295 through nucleotide residue number 2025, including the stop codon, wherein T can also be U;

(XXII) a polynucleotide comprising, consisting essentially of, or consisting of the sequence as shown in FIG. 2U, from nucleotide residue number 295 through nucleotide residue number 2025, including the stop codon, wherein T can also be U;

(XXIII) a polynucleotide comprising, consisting essentially of, or consisting of the sequence as shown in FIG. 2V, from nucleotide residue number 295 through nucleotide residue number 2025, including the stop codon, wherein T can also be U;

(XXIV) a polynucleotide comprising, consisting essentially of, or consisting of the sequence as shown in FIG. 2W, from nucleotide residue number 295 through nucleotide residue number 2025, including the stop codon, wherein T can also be U;

(XXV) a polynucleotide comprising, consisting essentially of, or consisting of the sequence as shown in FIG. 2X, from nucleotide residue number 295 through nucleotide residue number 2025, including the stop codon, wherein T can also be U;

(XXVI) a polynucleotide comprising, consisting essentially of, or consisting of the sequence as shown in FIG. 2Y, from nucleotide residue number 394 through nucleotide residue number 1866, including the stop codon, wherein T can also be U;

(XXVII) a polynucleotide comprising, consisting essentially of, or consisting of the sequence as shown in FIG. 2Z, from nucleotide residue number 394 through nucleotide residue number 1866, including the stop codon, wherein T can also be U;

(XXVIII) a polynucleotide comprising, consisting essentially of, or consisting of the sequence as shown in FIG. 2M, from nucleotide residue number 394 through nucleotide residue number 1866, including the stop codon, wherein T can also be U;

(XXIX) a polynucleotide comprising, consisting essentially of, or consisting of the sequence as shown in FIG. 2AB, from nucleotide residue number 394 through nucleotide residue number 1866, including the stop codon, wherein T can also be U;

(XXX) a polynucleotide comprising, consisting essentially of, or consisting of the sequence as shown in FIG. 2AC, from nucleotide residue number 394 through nucleotide residue number 1866, including the stop codon, wherein T can also be U;

(XXXI) a polynucleotide comprising, consisting essentially of, or consisting of the sequence as shown in FIG. 2AD, from nucleotide residue number 394 through nucleotide residue number 1866, including the stop codon, wherein T can also be U;

(XXXII) a polynucleotide comprising, consisting essentially of, or consisting of the sequence as shown in FIG. 2AE, from nucleotide residue number 394 through nucleotide residue number 1866, including the stop codon, wherein T can also be U;

(XXXIII) a polynucleotide comprising, consisting essentially of, or consisting of the sequence as shown in FIG. 2AF, from nucleotide residue number 394 through nucleotide residue number 1866, including the stop codon, wherein T can also be U;

(XXIV) a polynucleotide comprising, consisting essentially of, or consisting of the sequence as shown in FIG. 2AG, from nucleotide residue number 394 through nucleotide residue number 1866, including the stop codon, wherein T can also be U;

(XXXV) a polynucleotide comprising, consisting essentially of, or consisting of the sequence as shown in FIG. 2AH, from nucleotide residue number 394 through nucleotide residue number 1866, including the stop codon, wherein T can also be U;

(XXXVI) a polynucleotide comprising, consisting essentially of, or consisting of the sequence as shown in FIG. 2AI, from nucleotide residue number 394 through nucleotide residue number 1866, including the stop codon, wherein T can also be U;

(XXXVII) a polynucleotide comprising, consisting essentially of, or consisting of the sequence as shown in FIG. 2AJ, from nucleotide residue number 394 through nucleotide residue number 1866, including the stop codon, wherein T can also be U;

(XXXVIII) a polynucleotide comprising, consisting essentially of, or consisting of the sequence as shown in FIG. 2AK, from nucleotide residue number 394 through nucleotide residue number 1866, including the stop codon, wherein T can also be U;

(XXXIX) a polynucleotide comprising, consisting essentially of, or consisting of the sequence as shown in FIG. 2AL, from nucleotide residue number 394 through nucleotide residue number 1866, including the stop codon, wherein T can also be U;

(XL) a polynucleotide that encodes a 98P4B6-related protein that is at least 90, 91, 92, 93, 94, 95, 96, 97, 98, 99 or 100% homologous to an entire amino acid sequence shown in FIG. 2A-AL;

(XLI) a polynucleotide that encodes a 98P4B6-related protein that is at least 90, 91, 92, 93, 94, 95, 96, 97, 98, 99 or 100% identical to an entire amino acid sequence shown in FIG. 2A-AL;

(XLII) a polynucleotide that encodes at least one peptide set forth in Tables VIII-XXI and XXII-XLIX;

(XLIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3A, 3G, and 3H in any whole number increment up to 454 that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XLIV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3A, 3G, and 3H in any whole number increment up to 454 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XLV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3A, 3G, and 3H in any whole number increment up to 454 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XLVI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3A, 3G, and 3H in any whole number increment up to 454 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XLVII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3A, 3G, and 3H in any whole number increment up to 454 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XLVIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3B in any whole number increment up to 45 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XLIX) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3B in any whole number increment up to 45 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(L) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3B in any whole number increment up to 45 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(LI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3B in any whole number increment up to 45 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(LII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3B in any whole number increment up to 45 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9

(LIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3C in any whole number increment up to 419 that includes 1, 2, 3, 4, 5, 6, 7, 8, 9, 10; 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(LIV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3C in any whole number increment up to 419 that includes 1, 2, 3, 4, 5, 6, 7, 8, 9, 10, 11, 12, 13, 14, 15, 16, 17, 18,19, 20, 21, 22, 23, 24, 25, 26, 27, 28, 29, 30, 31, 32, 33, 34, 35 amino acid position(s) having a value less than 0.5 in the Hydropathicity profile of FIG. 6;

(LV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3C in any whole number increment up to 419 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(LVI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3C in any whole number increment up to 419 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(LVII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3C in any whole number increment up to 419 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9

(LVIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3D, 3F, and 3J in any whole number increment up to 490 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(LIX) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3D, 3F, and 3J in any whole number increment up to 490 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(LX) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3D, 3F, and 3J in any whole number increment up to 490 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(LXI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3D, 3F, and 3J in any whole number increment up to 490 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(LXII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3D, 3F, and 3J in any whole number increment up to 490 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9

(LXIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3E and 3I in any whole number increment up to 576 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(LXIV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3E and 3I in any whole number increment up to 576 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(LXV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3E and 3I in any whole number increment up to 576 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(LXVI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3E and 3I in any whole number increment up to 576 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(LXVII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3E and 3I in any whole number increment up to 576 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9

(LXVIII) a polynucleotide that is fully complementary to a polynucleotide of any one of (I)-(LXVII).

(LXIX) a peptide that is encoded by any of (I) to (LXVIII); and (LXX) a composition comprising a polynucleotide of any of (I)-(LXVIII) or peptide of (LXIX) together with a pharmaceutical excipient and/or in a human unit dose form.

(LXXI) a method of using a polynucleotide of any (I)-(LXVIII) or peptide of (LXIX) or a composition of (LXX) in a method to modulate a cell expressing 98P4B6, (LXXII) a method of using a polynucleotide of any (I)-(LXVIII) or peptide of (LXIX) or a composition of (LXX) in a method to diagnose, prophylax, prognose, or treat an individual who bears a cell expressing 98P4B6

(LXXIII) a method of using a polynucleotide of any (I)-(LXVIII) or peptide of (LXIX) or a composition of (LXX) in a method to diagnose, prophylax, prognose, or treat an individual who bears a cell expressing 98P4B6, said cell from a cancer of a tissue listed in Table I;

(LXXIV) a method of using a polynucleotide of any (I)-(LXVIII) or peptide of (LXIX) or a composition of (LXX) in a method to diagnose, prophylax, prognose, or treat a cancer;

(LXXV) a method of using a polynucleotide of any (I)-(LXVIII) or peptide of (LXIX) or a composition of (LXX) in a method to diagnose, prophylax, prognose, or treat a cancer of a tissue listed in Table I; and, (LXXVI) a method of using a polynucleotide of any (I)-(LXVIII) or peptide of (LXIX) or a composition of (LXX) in a method to identify or characterize a modulator of a cell expressing 98P4B6.

As used herein, a range is understood to disclose specifically all whole unit positions thereof.

Typical embodiments of the invention disclosed herein include 98P4B6 polynucleotides that encode specific portions of 98P4B6 mRNA sequences (and those which are complementary to such sequences) such as those that encode the proteins and/or fragments thereof, for example:

(a) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 225, 250, 275, 300, 325, 350, 375, 400, 410, 420, 430, 440, 450 or 454 or more contiguous amino acids of 98P4B6 variant 1; the maximal lengths relevant for other variants are: variant 2, 44 amino acids; variant 5, 419 amino acids, variant 6, 490 amino acids, variant 7, 576 amino acids, variant 8, 490 amino acids, variant 13, 454 amino acids, variant 14, 454 amino acids, variant 21, 576 amino acids, and variant 25, 490 amino acids.

For example, representative embodiments of the invention disclosed herein include: polynucleotides and their encoded peptides themselves encoding about amino acid 1 to about amino acid 10 of the 98P4B6 protein shown in FIG. 2 or FIG. 3, polynucleotides encoding about amino acid 10 to about amino acid 20 of the 98P4B6 protein shown in FIG. 2 or FIG. 3, polynucleotides encoding about amino acid 20 to about amino acid 30 of the 98P4B6 protein shown in FIG. 2 or FIG. 3, polynucleotides encoding about amino acid 30 to about amino acid 40 of the 98P4B6 protein shown in FIG. 2 or FIG. 3, polynucleotides encoding about amino acid 40 to about amino acid 50 of the 98P4B6 protein shown in FIG. 2 or FIG. 3, polynucleotides encoding about amino acid 50 to about amino acid 60 of the 98P4B6 protein shown in FIG. 2 or FIG. 3, polynucleotides encoding about amino acid 60 to about amino acid 70 of the 98P4B6 protein shown in FIG. 2 or FIG. 3, polynucleotides encoding about amino acid 70 to about amino acid 80 of the 98P4B6 protein shown in FIG. 2 or FIG. 3, polynucleotides encoding about amino acid 80 to about amino acid 90 of the 98P4B6 protein shown in FIG. 2 or FIG. 3, polynucleotides encoding about amino acid 90 to about amino acid 100 of the 98P4B6 protein shown in FIG. 2 or FIG. 3, in increments of about 10 amino acids, ending at the carboxyl terminal amino acid set forth in FIG. 2 or FIG. 3. Accordingly, polynucleotides encoding portions of the amino acid sequence (of about 10 amino acids), of amino acids, 100 through the carboxyl terminal amino acid of the 98P4B6 protein are embodiments of the invention. Wherein it is understood that each particular amino acid position discloses that position plus or minus five amino acid residues.

Polynucleotides encoding relatively long portions of a 98P4B6 protein are also within the scope of the invention. For example, polynucleotides encoding from about amino acid 1 (or 20 or 30 or 40 etc.) to about amino acid 20, (or 30, or 40 or 50 etc.) of the 98P4B6 protein "or variant" shown in FIG. 2 or FIG. 3 can be generated by a variety of techniques well known in the art. These polynucleotide fragments can include any portion of the 98P4B6 sequence as shown in FIG. 2.

Additional illustrative embodiments of the invention disclosed herein include 98P4B6 polynucleotide fragments encoding one or more of the biological motifs contained within a 98P4B6 protein "or variant" sequence, including one or more of the motif-bearing subsequences of a 98P4B6 protein "or variant" set forth in Tables VIII-XXI and XXII-XLIX. In another embodiment, typical polynucleotide fragments of the invention encode one or more of the regions of 98P4B6 protein or variant that exhibit homology to a known molecule. In another embodiment of the invention, typical polynucleotide fragments can encode one or more of the 98P4B6 protein or variant N-glycosylation sites, cAMP and cGMP-dependent protein kinase phosphorylation sites, casein kinase II phosphorylation sites or N-myristoylation site and amidation sites.

Note that to determine the starting position of any peptide set forth in Tables VIII-XXI and Tables XXII to XLIX (collectively HLA Peptide Tables) respective to its parental protein, e.g., variant 1, variant 2, etc., reference is made to three factors: the particular variant, the length of the peptide in an HLA Peptide Table, and the Search Peptides listed in Table VII. Generally, a unique Search Peptide is used to obtain HLA peptides for a particular variant. The position of each Search Peptide relative to its respective parent molecule is listed in Table VII. Accordingly, if a Search Peptide begins at position "X", one must add the value "X minus 1" to each position in Tables VIII-XXI and Tables XXII-IL to obtain the actual position of the HLA peptides in their parental molecule. For example if a particular Search Peptide begins at position 150 of its parental molecule, one must add 150-1, i.e., 149 to each HLA peptide amino acid position to calculate the position of that amino acid in the parent molecule.

II.A.) Uses of 98P4B6 Polynucleotides

II.A.1.) Monitoring of Genetic Abnormalities

The polynucleotides of the preceding paragraphs have a number of different specific uses. The human 98P4B6 gene maps to the chromosomal location set forth in the Example entitled "Chromosomal Mapping of 98P4B6." For example, because the 98P4B6 gene maps to this chromosome, polynucleotides that encode different regions of the 98P4B6 proteins are used to characterize cytogenetic abnormalities of this chromosomal locale, such as abnormalities that are identified as being associated with various cancers. In certain genes, a variety of chromosomal abnormalities including rearrangements have been identified as frequent cytogenetic abnormalities in a number of different cancers (see e.g. Krajinovic et al., Mutat. Res. 382(3-4): 81-83 (1998); Johansson et al., Blood 86(10): 3905-3914 (1995) and Finger et al., P.N.A.S. 85(23): 9158-9162 (1988)). Thus, polynucleotides encoding specific regions of the 98P4B6 proteins provide new tools that can be used to delineate, with greater precision than previously possible, cytogenetic abnormalities in the chromosomal region that encodes 98P4B6 that may contribute to the malignant phenotype. In this context, these polynucleotides satisfy a need in the art for expanding the sensitivity of chromosomal screening in order to identify more subtle and less common chromosomal abnormalities (see e.g. Evans et al., Am. J. Obstet. Gynecol 171(4): 1055-1057 (1994)).

Furthermore, as 98P4B6 was shown to be highly expressed in prostate and other cancers, 98P4B6 polynucleotides are used in methods assessing the status of 98P4B6 gene products in normal versus cancerous tissues. Typically, polynucleotides that encode specific regions of the 98P4B6 proteins are used to assess the presence of perturbations (such as deletions, insertions, point mutations, or alterations resulting in a loss of an antigen etc.) in specific regions of the 98P4B6 gene, such as regions containing one or more motifs. Exemplary assays include both RT-PCR assays as well as single-strand conformation polymorphism (SSCP) analysis (see, e.g., Marrogi et al, J. Cutan. Pathol. 26(8): 369-378 (1999), both of which utilize polynucleotides encoding specific regions of a protein to examine these regions within the protein.

II.A.2.) Antisense Embodiments

Other specifically contemplated nucleic acid related embodiments of the invention disclosed herein are genomic DNA, cDNAs, ribozymes, and antisense molecules, as well as nucleic acid molecules based on an alternative backbone, or including alternative bases, whether derived from natural sources or synthesized, and include molecules capable of inhibiting the RNA or protein expression of 98P4B6. For example, antisense molecules can be RNAs or other molecules, including peptide nucleic acids (PNAs) or non-nucleic acid molecules such as phosphorothioate derivatives that specifically bind DNA or RNA in a base pair-dependent manner. A skilled artisan can readily obtain these classes of nucleic acid molecules using the 98P4B6 polynucleotides and polynucleotide sequences disclosed herein.

Antisense technology entails the administration of exogenous oligonucleotides that bind to a target polynucleotide located within the cells. The term "antisense" refers to the fact that such oligonucleotides are complementary to their intracellular targets, e.g., 98P4B6. See for example, Jack Cohen, Oligodeoxynucleotides, Antisense Inhibitors of Gene Expression, CRC Press, 1989; and Synthesis 1:1-5 (1988). The 98P4B6 antisense oligonucleotides of the present invention include derivatives such as S-oligonucleotides (phosphorothioate derivatives or S-oligos, see, Jack Cohen, supra), which exhibit enhanced cancer cell growth inhibitory action. S-oligos (nucleoside phosphorothioates) are isoelectronic analogs of an oligonucleotide (O-oligo) in which a nonbridging oxygen atom of the phosphate group is replaced by a sulfur atom. The S-oligos of the present invention can be prepared by treatment of the corresponding O-oligos with 3H-1,2-benzodithiol-3-one-1,1-dioxide, which is a sulfur transfer reagent. See, e.g., Iyer, R. P. et al., J. Org. Chem. 55:4693-4698 (1990); and Iyer, R. P. et al., J. Am. Chem. Soc. 112:1253-1254 (1990). Additional 98P4B6 antisense oligonucleotides of the present invention include morpholino antisense oligonucleotides known in the art (see, e.g., Partridge et al, 1996, Antisense & Nucleic Acid Drug Development 6: 169-175).

The 98P4B6 antisense oligonucleotides of the present invention typically can be RNA or DNA that is complementary to and stably hybridizes with the first 100 5' codons or last 100 3' codons of a 98P4B6 genomic sequence or the corresponding mRNA. Absolute complementarity is not required, although high degrees of complementarity are preferred. Use of an oligonucleotide complementary to this region allows for the selective hybridization to 98P4B6 mRNA and not to mRNA specifying other regulatory subunits of protein kinase. In one embodiment, 98P4B6 antisense oligonucleotides of the present invention are 15 to 30-mer fragments of the antisense DNA molecule that have a sequence that hybridizes to 98P4B6 mRNA. Optionally, 98P4B6 antisense oligonucleotide is a 30-mer oligonucleotide that is complementary to a region in the first 10 5' codons or last 10 3' codons of 98P4B6. Alternatively, the antisense molecules are modified to employ ribozymes in the inhibition of 98P4B6 expression, see, e.g., L. A. Couture & D. T. Stinchcomb; *Trends Genet* 12: 510-515 (1996).

II.A.3.) Primers and Primer Pairs

Further specific embodiments of these nucleotides of the invention include primers and primer pairs, which allow the specific amplification of polynucleotides of the invention or of any specific parts thereof, and probes that selectively or specifically hybridize to nucleic acid molecules of the invention or to any part thereof. Probes can be labeled with a detectable marker, such as, for example, a radioisotope, fluorescent compound, bioluminescent compound, a chemiluminescent compound, metal chelator or enzyme. Such probes and primers are used to detect the presence of a 98P4B6 polynucleotide in a sample and as a means for detecting a cell expressing a 98P4B6 protein.

Examples of such probes include polypeptides comprising all or part of the human 98P4B6 cDNA sequence shown in FIG. 2. Examples of primer pairs capable of specifically amplifying 98P4B6 mRNAs are also described in the Examples. As will be understood by the skilled artisan, a great many different primers and probes can be prepared based on the sequences provided herein and used effectively to amplify and/or detect a 98P4B6 mRNA.

The 98P4B6 polynucleotides of the invention are useful for a variety of purposes, including but not limited to their use as probes and primers for the amplification and/or detection of the 98P4B6 gene(s), mRNA(s), or fragments thereof; as reagents for the diagnosis and/or prognosis of prostate cancer and other cancers; as coding sequences capable of directing the expression of 98P4B6 polypeptides; as tools for modulating or inhibiting the expression of the 98P4B6 gene(s) and/or translation of the 98P4B6 transcript(s); and as therapeutic agents.

The present invention includes the use of any probe as described herein to identify and isolate a 98P4B6 or 98P4B6 related nucleic acid sequence from a naturally occurring source, such as humans or other mammals, as well as the isolated nucleic acid sequence per se, which would comprise all or most of the sequences found in the probe used.

II.A.4.) Isolation of 98P4B6-Encoding Nucleic Acid Molecules

The 98P4B6 cDNA sequences described herein enable the isolation of other polynucleotides encoding 98P4B6 gene product(s), as well as the isolation of polynucleotides encoding 98P4B6 gene product homologs, alternatively spliced isoforms, allelic variants, and mutant forms of a 98P4B6 gene product as well as polynucleotides that encode analogs of 98P4B6-related proteins. Various molecular cloning methods that can be employed to isolate full length cDNAs encoding a 98P4B6 gene are well known (see, for example, Sambrook, J. et al., Molecular Cloning: A Laboratory Manual, 2d edition, Cold Spring Harbor Press, New York, 1989; Current Protocols in Molecular Biology. Ausubel et al., Eds., Wiley and Sons, 1995). For example, lambda phage cloning methodologies can be conveniently employed, using commercially available cloning systems (e.g., Lambda ZAP Express, Stratagene). Phage clones containing 98P4B6 gene cDNAs can be identified by probing with a labeled 98P4B6 cDNA or a fragment thereof. For example, in one embodiment, a 98P4B6 cDNA (e.g., FIG. 2) or a portion thereof can be synthesized and used as a probe to retrieve overlapping and full-length cDNAs corresponding to a 98P4B6 gene. A 98P4B6 gene itself can be isolated by screening genomic DNA libraries, bacterial artificial chromosome libraries (BACs), yeast artificial chromosome libraries (YACs), and the like, with 98P4B6 DNA probes or primers.

II.A.5.) Recombinant Nucleic Acid Molecules and Host-Vector Systems

The invention also provides recombinant DNA or RNA molecules containing a 98P4B6 polynucleotide, a fragment, analog or homologue thereof, including but not limited to phages, plasmids, phagemids, cosmids, YACs, BACs, as well as various viral and non-viral vectors well known in the art, and cells transformed or transfected with such recombinant DNA or RNA molecules. Methods for generating such molecules are well known (see, for example, Sambrook et al., 1989, supra).

The invention further provides a host-vector system comprising a recombinant DNA molecule containing a 98P486 polynucleotide, fragment, analog or homologue thereof within a suitable prokaryotic or eukaryotic host cell. Examples of suitable eukaryotic host cells include a yeast cell, a plant cell, or an animal cell, such as a mammalian cell or an insect cell (e.g., a baculovirus-infectible cell such as an Sf9 or HighFive cell). Examples of suitable mammalian cells include various prostate cancer cell lines such as DU145 and TsuPr1, other transfectable or transducible prostate cancer cell lines, primary cells (PrEC), as well as a number of mammalian cells routinely used for the expression of recombinant proteins (e.g., COS, CHO, 293, 293T cells). More particularly, a polynucleotide comprising the coding sequence of 98P4B6 or a fragment, analog or homolog thereof can be used to generate 98P4B6 proteins or fragments thereof using any number of host-vector systems routinely used and widely known in the art.

A wide range of host-vector systems suitable for the expression of 98P4B6 proteins or fragments thereof are available, see for example, Sambrook et al., 1989, supra; Current Protocols in Molecular Biology, 1995, supra). Preferred vectors for mammalian expression include but are not limited to pcDNA 3.1 myc-His-tag (Invitrogen) and the retroviral vector pSRαtkneo (Muller et al., 1991, MCB 11:1785). Using these expression vectors, 98P4B6 can be expressed in several prostate cancer and non-prostate cell lines, including for example 293, 293T, rat-1, NIH 3T3 and TsuPr1. The host-vector systems of the invention are useful for the production of a 98P4B6 protein or fragment thereof. Such host-vector systems can be employed to study the functional properties of 98P4B6 and 98P4B6 mutations or analogs.

Recombinant human 98P4B6 protein or an analog or homolog or fragment thereof can be produced by mammalian cells transfected with a construct encoding a 98P4B6-related nucleotide. For example, 293T cells can be transfected with an expression plasmid encoding 98P4B6 or fragment, analog or homolog thereof, a 98P4B6-related protein is expressed in the 293T cells, and the recombinant 98P4B6 protein is isolated using standard purification methods (e.g., affinity purification using anti-98P4B6 antibodies). In another embodiment, a 98P4B6 coding sequence is subcloned into the retroviral vector pSRαMSVtkneo and used to infect various mammalian cell lines, such as NIH 3T3, TsuPr1, 293 and rat-1 in order to establish 98P4B6 expressing cell lines. Various other expression systems well known in the art can also be employed. Expression constructs encoding a leader peptide joined in frame to a 98P4B6 coding sequence can be used for the generation of a secreted form of recombinant 98P4B6 protein.

As discussed herein, redundancy in the genetic code permits variation in 98P4B6 gene sequences. In particular, it is known in the art that specific host species often have specific codon preferences, and thus one can adapt the disclosed sequence as preferred for a desired host. For example, preferred analog codon sequences typically have rare codons (i.e., codons having a usage frequency of less than about 20% in known sequences of the desired host) replaced with higher frequency codons. Codon preferences for a specific species are calculated, for example, by utilizing codon usage tables available on the INTERNET.

Additional sequence modifications are known to enhance protein expression in a cellular host. These include elimination of sequences encoding spurious polyadenylation signals, exon/intron splice site signals, transposon-like repeats, and/or other such well-characterized sequences that are deleterious to gene expression. The GC content of the sequence is adjusted to levels average for a given cellular host, as calculated by reference to known genes expressed in the host cell. Where possible, the sequence is modified to avoid predicted hairpin secondary mRNA structures. Other useful modifications include the addition of a translational initiation consensus sequence at the start of the open reading frame, as described in Kozak, Mol. Cell Biol., 9:5073-5080 (1989). Skilled artisans understand that the general rule that eukaryotic ribosomes initiate translation exclusively at the 5' proximal AUG codon is abrogated only under rare conditions (see, e.g., Kozak PNAS 92(7): 2662-2666, (1995) and Kozak NAR 15(20): 8125-8148 (1987)).

III.) 98P4B6-Related Proteins

Another aspect of the present invention provides 98P4B6-related proteins. Specific embodiments of 98P4B6 proteins comprise a polypeptide having all or part of the amino acid sequence of human 98P4B6 as shown in FIG. 2 or FIG. 3. Alternatively, embodiments of 98P4B6 proteins comprise variant, homolog or analog polypeptides that have alterations in the amino acid sequence of 98P4B6 shown in FIG. 2 or FIG. 3.

Embodiments of a 98P4B6 polypeptide include: a 98P4B6 polypeptide having a sequence shown in FIG. 2, a peptide sequence of a 98P4B6 as shown in FIG. 2 wherein T is U; at least 10 contiguous nucleotides of a polypeptide having the sequence as shown in FIG. 2; or, at least 10 contiguous peptides of a polypeptide having the sequence as shown in FIG. 2 where T is U. For example, embodiments of 98P4B6 peptides comprise, without limitation:

(I) a protein comprising, consisting essentially of, or consisting of an amino acid sequence as shown in FIG. 2A-AL or FIG. 3A-J;

(II) a 98P4B6-related protein that is at least 90, 91, 92, 93, 94, 95, 96, 97, 98, 99 or 100% homologous to an entire amino acid sequence shown in FIG. 2A-AL;

(III) a 98P4B6-related protein that is at least 90, 91, 92, 93, 94, 95, 96, 97, 98, 99 or 100% identical to an entire amino acid sequence shown in FIG. 2A-AL or 3A-J;

(IV) a protein that comprises at least one peptide set forth in Tables VIII to XLIX, optionally with a proviso that it is not an entire protein of FIG. 2;

(V) a protein that comprises at least one peptide set forth in Tables VIII-XXI, collectively, which peptide is also set forth in Tables XXII to XLIX, collectively, optionally with a proviso that it is not an entire protein of FIG. 2;

(VI) a protein that comprises at least two peptides selected from the peptides set forth in Tables VIII-XLIX, optionally with a proviso that it is not an entire protein of FIG. 2;

(VII) a protein that comprises at least two peptides selected from the peptides set forth in Tables VIII to XLIX collectively, with a proviso that the protein is not a contiguous sequence from an amino acid sequence of FIG. 2;

(VIII) a protein that comprises at least one peptide selected from the peptides set forth in Tables VIII-XXI; and at least one peptide selected from the peptides set forth in Tables XXII to XLIX, with a proviso that the protein is not a contiguous sequence from an amino acid sequence of FIG. 2;

(IX) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIGS. 3A, 3B, 3C, 3D, 3E, 3F, 3G, 3H, 3I or 3J in any whole number increment up to 454, 45, 419, 490, 576, 490, 454, 454, 576, or 490 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(X) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIGS. 3A, 3B, 3C, 3D, 3E, 3F, 3G, 3H, 3I or 3J in any whole number increment up to 454, 45, 419, 490, 576, 490, 454, 454, 576, or 490 respectively that includes at least at least 1, 2, 3, 4, 5, 6, 7,8,9, 10, 11, 12, 13, 14, 15, 16, 17, 18, 19, 20, 21, 22, 23, 24, 25, 26, 27, 28, 29,30, 31,32,33, 34,35 amino acid position(s) having a value less than 0.5 in the Hydropathicity profile of FIG. 6;

(XI) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIGS. 3A, 3B, 3C, 3D, 3E, 3F, 3G, 3H, 3I or 3J in any whole number increment up to 454, 45, 419, 490, 576, 490, 454, 454, 576, or 490 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIGS. 3A, 3B, 3C, 3D, 3E, 3F, 3G, 3H, 3I or 3J in any whole number increment up to 454, 45, 419, 490, 576, 490, 454, 454, 576, or 490 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XIII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, amino acids of a protein of FIGS. 3A, 3B, 3C, 3D, 3E, 3F, 3G, 3H, 3I or 3J in any whole number increment up to 454, 45, 419, 490, 576, 490, 454, 454, 576, or 490 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XIV) a peptide that occurs at least twice in Tables VIII-XXI and XXII to XLIX, collectively;

(XV) a peptide that occurs at least three times in Tables VIII-XXI and XXII to XLIX, collectively;

(XVI) a peptide that occurs at least four times in Tables VIII-XXI and XXII to XLIX, collectively;

(XVII) a peptide that occurs at least five times in Tables VIII-XXI and XXII to XLIX, collectively;

(XVIII) a peptide that occurs at least once in Tables VIII-XXI, and at least once in tables XXII to XLIX;

(XIX) a peptide that occurs at least once in Tables VIII-XXI, and at least twice in tables XXII to XLIX;

(XX) a peptide that occurs at least twice in Tables VIII-XXI, and at least once in tables XXII to XLIX;

(XXI) a peptide that occurs at least twice in Tables VIII-XXI, and at least twice in tables XXII to XLIX;

(XXII) a peptide which comprises one two, three, four, or five of the following characteristics, or an oligonucleotide encoding such peptide:

i) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Hydrophilicity profile of FIG. 5;

ii) a region of at least 5 amino acids of a particular peptide of FIG. 3, in any whole number increment up to the full length of that protein in FIG. 3, that includes an amino acid position having a value equal to or less than 0.5, 0.4, 0.3, 0.2, 0.1, or having a value equal to 0.0, in the Hydropathicity profile of FIG. 6;

iii) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Percent Accessible Residues profile of FIG. 7;

iv) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Average Flexibility profile of FIG. 8; or, v) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Beta-turn profile of FIG. 9;

(XXIII) a composition comprising a peptide of (I)-(XXII) or an antibody or binding region thereof together with a pharmaceutical excipient and/or in a human unit dose form.

(XXIV) a method of using a peptide of (I)-(XXII), or an antibody or binding region thereof or a composition of (XXIII) in a method to modulate a cell expressing 98P4B6, (XXV) a method of using a peptide of (I)-(XXII) or an antibody or binding region thereof or a composition of (XXIII) in a method to diagnose, prophylax, prognose, or treat an individual who bears a cell expressing 98P4B6

(XXVI) a method of using a peptide of (I)-(XXII) or an antibody or binding region thereof or a composition (XXIII) in a method to diagnose, prophylax, prognose, or treat an individual who bears a cell expressing 98P4B6, said cell from a cancer of a tissue listed in Table I;

(XXVII) a method of using a peptide of (I)-(XXII) or an antibody or binding region thereof or a composition of (XXIII) in a method to diagnose, prophylax, prognose, or treat a cancer;

(XXVIII) a method of using a peptide of (I)-(XXII) or an antibody or binding region thereof or a composition of (XXIII) in a method to diagnose, prophylax, prognose, or treat a cancer of a tissue listed in Table I; and, (XXIX) a method of using a peptide of (I)-(XXII) or an antibody or binding region thereof or a composition (XXII I) in a method to identify or characterize a modulator of a cell expressing 98P4B6.

As used herein, a range is understood to specifically disclose all whole unit positions thereof.

Typical embodiments of the invention disclosed herein include 98P4B6 polynucleotides that encode specific portions of 98P4B6 mRNA sequences (and those which are complementary to such sequences) such as those that encode the proteins and/or fragments thereof, for example:

(a) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 225, 250, 275, 300, 325, 350, 375, 400, 410, 420, 430, 440, 450, or 454 more contiguous amino acids of 98P4B6 variant 1; the maximal lengths relevant for other variants are: variant 52, 45 amino acids; variant 5, 419 amino acids, variant 6,490, variant 7, 576 amino acids, variant 8, 490 amino acids, variant 13, 454, variant 14, 454 amino acids, variant 21, 576 amino acids, and variant 25, 490 amino acids.

In general, naturally occurring allelic variants of human 98P4B6 share a high degree of structural identity and homology (e.g., 90% or more homology). Typically, allelic variants of a 98P4B6 protein contain conservative amino acid substitutions within the 98P4B6 sequences described herein or contain a substitution of an amino add from a corresponding position in a homologue of 98P4B6. One class of 98P4B6 allelic variants are proteins that share a high degree of homology with at least a small region of a particular 98P4B6 amino acid sequence, but further contain a radical departure from the sequence, such as a non-conservative substitution, truncation, insertion or frame shift. In comparisons of protein sequences, the terms, similarity, identity, and homology each have a distinct meaning as appreciated in the field of genetics. Moreover, orthology and paralogy can be important concepts describing the relationship of members of a given protein family in one organism to the members of the same family in other organisms.

Amino acid abbreviations are provided in Table II. Conservative amino acid substitutions can frequently be made in a protein without altering either the conformation or the function of the protein. Proteins of the invention can comprise 1, 2, 3, 4, 5, 6, 7, 8, 9, 10, 11, 12, 13, 14, 15 conservative substitutions. Such changes include substituting any of isoleucine (I), valine (V), and leucine (L) for any other of these hydrophobic amino acids; aspartic acid (D) for glutamic acid (E) and vice versa; glutamine (Q) for asparagine (N) and vice versa; and serine (S) for threonine (T) and vice versa. Other substitutions can also be considered conservative, depending on the environment of the particular amino acid and its role in the three-dimensional structure of the protein. For example, glycine (G) and alanine (A) can frequently be interchangeable, as can alanine (A) and valine (V). Methionine (M), which is relatively hydrophobic, can frequently be interchanged with leucine and isoleucine, and sometimes with valine. Lysine (K) and arginine (R) are frequently interchangeable in locations in which the significant feature of the amino acid residue is its charge and the differing pK's of these two amino acid residues are not significant. Still other changes can be considered "conservative" in particular environments (see, e.g. Table III herein; pages 13-15 "Biochemistry" $2^{nd}$ ED. Lubert Stryer ed (Stanford University); Henikoff et al., PNAS 1992 Vol 89 10915-10919; Lei et al., J Biol Chem 1995 May 19; 270(20):11882-6).

Embodiments of the invention disclosed herein include a wide variety of art-accepted variants or analogs of 98P4B6 proteins such as polypeptides having amino acid insertions, deletions and substitutions. 98P4B6 variants can be made using methods known in the art such as site-directed mutagenesis, alanine scanning, and PCR mutagenesis. Site-directed mutagenesis (Carter et al., *Nucl. Acids Res.*, 13:4331 (1986); Zoller et al., *Nucl. Acids Res.*, 10:6487 (1987)), cassette mutagenesis (Wells et al., Gene, 34:315 (1985)), restriction selection mutagenesis (Wells et al., *Philos. Trans. R. Soc. London SerA*, 317:415 (1986)) or other known techniques can be performed on the cloned DNA to produce the 98P4B6 variant DNA.

Scanning amino acid analysis can also be employed to identify one or more amino acids along a contiguous sequence that is involved in a specific biological activity such as a protein-protein interaction. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant. Alanine is also typically preferred because it is the most common amino acid. Further, it is frequently found in both buried and exposed positions (Creighton, *The Proteins*, (W.H. Freeman & Co., N.Y.); Chothia, J. Mol. Biol., 150:1 (1976)). If alanine substitution does not yield adequate amounts of variant, an isosteric amino acid can be used.

As defined herein, 98P486 variants, analogs or homologs, have the distinguishing attribute of having at least one epitope that is "cross reactive" with a 98P4B6 protein having an amino acid sequence of FIG. 3. As used in this sentence, "cross reactive" means that an antibody or T cell that specifically binds to a 98P4B6 variant also specifically binds to a 98P4B6 protein having an amino acid sequence set forth in FIG. 3. A polypeptide ceases to be a variant of a protein shown in FIG. 3, when it no longer contains any epitope capable of being recognized by an antibody or T cell that specifically binds to the starting 98P4B6 protein. Those skilled in the art understand that antibodies that recognize proteins bind to epitopes of varying size, and a grouping of the order of about four or five amino acids, contiguous or not, is regarded as a typical number of amino acids in a minimal epitope. See, e.g., Nair et al., J. Immunol 2000 165(12): 6949-6955; Hebbes et al., Mol Immunol (1989) 26(9):865-73; Schwartz et al., J Immunol (1985) 135(4):2598-608.

Other classes of 98P4B6-related protein variants share 70%, 75%, 80%, 85% or 90% or more similarity with an amino acid sequence of FIG. 3, or a fragment thereof. Another specific class of 98P4B6 protein variants or analogs comprises one or more of the 98P4B6 biological motifs described herein or presently known in the art. Thus, encompassed by the present invention are analogs of 98P4B6 fragments (nucleic or amino acid) that have altered functional (e.g. immunogenic) properties relative to the starting fragment. It is to be appreciated that motifs now or which become part of the art are to be applied to the nucleic or amino acid sequences of FIG. 2 or FIG. 3.

As discussed herein, embodiments of the claimed invention include polypeptides containing less than the full amino acid sequence of a 98P4B6 protein shown in FIG. 2 or FIG. 3. For example, representative embodiments of the invention comprise peptides/proteins having any 4, 5, 6, 7, 8, 9, 10, 11, 12, 13, 14, 15 or more contiguous amino acids of a 98P4B6 protein shown in FIG. 2 or FIG. 3.

Moreover, representative embodiments of the invention disclosed herein include polypeptides consisting of about amino acid 1 to about amino acid 10 of a 98P4B6 protein shown in FIG. 2 or FIG. 3, polypeptides consisting of about amino acid 10 to about amino acid 20 of a 98P4B6 protein shown in FIG. 2 or FIG. 3, polypeptides consisting of about amino acid 20 to about amino acid 30 of a 98P4B6 protein shown in FIG. 2 or FIG. 3, polypeptides consisting of about amino acid 30 to about amino acid 40 of a 98P486 protein shown in FIG. 2 or FIG. 3, polypeptides consisting of about amino acid 40 to about amino acid 50 of a 98P4B6 protein shown in FIG. 2 or FIG. 3, polypeptides consisting of about amino acid 50 to about amino acid 60 of a 98P4B6 protein shown in FIG. 2 or FIG. 3, polypeptides consisting of about amino acid 60 to about amino acid 70 of a 98P4B6 protein shown in FIG. 2 or FIG. 3, polypeptides consisting of about amino acid 70 to about amino acid 80 of a 98P4B6 protein shown in FIG. 2 or FIG. 3, polypeptides consisting of about amino acid 80 to about amino acid 90 of a 98P4B6 protein shown in FIG. 2 or FIG. 3, polypeptides consisting of about amino acid 90 to about amino acid 100 of a 98P4B6 protein shown in FIG. 2 or FIG. 3, etc. throughout the entirety of a 98P4B6 amino acid sequence. Moreover, polypeptides consisting of about amino acid 1 (or 20 or 30 or 40 etc.) to about amino acid 20, (or 130, or 140 or 150 etc.) of a 98P4B6 protein shown in FIG. 2 or FIG. 3 are embodiments of the invention. It is to be appreciated that the starting and stopping positions in this paragraph refer to the specified position as well as that position plus or minus 5 residues.

98P4B6-related proteins are generated using standard peptide synthesis technology or using chemical cleavage methods well known in the art. Alternatively, recombinant methods can be used to generate nucleic acid molecules that encode a 98P4B6-related protein. In one embodiment, nucleic acid molecules provide a means to generate defined fragments of a 98P4B6 protein (or variants, homologs or analogs thereof).

III.A.) Motif-bearing Protein Embodiments

Additional illustrative embodiments of the invention disclosed herein include 98P4B6 polypeptides comprising the amino acid residues of one or more of the biological motifs contained within a 98P4B6 polypeptide sequence set forth in FIG. 2 or FIG. 3. Various motifs are known in the art, and a protein can be evaluated for the presence of such motifs by a number of publicly available sequence analysis tools (see, e.g., PFAM; BCM Search Launcher; PSORT; CBS; InterProScan; ScanProsite; Epimatrix™ and Epimer™, Brown University; and BIMAS).

Motif bearing subsequences of all 98P4B6 variant proteins are set forth and identified in Tables VIII-XXI and XXII-XLIX.

Table V sets forth several frequently occurring motifs based on pfam searches. The columns of Table V list (1) motif name abbreviation, (2) percent identity found amongst the different member of the motif family, (3) motif name or description and (4) most common function; location information is included if the motif is relevant for location.

Polypeptides comprising one or more of the 98P4B6 motifs discussed above are useful in elucidating the specific characteristics of a malignant phenotype in view of the observation that the 98P4B6 motifs discussed above are associated with growth dysregulation and because 98P4B6 is overexpressed in certain cancers (See, e.g., Table I). Casein kinase II, cAMP and camp-dependent protein kinase, and Protein Kinase C, for example, are enzymes known to be associated with the development of the malignant phenotype (see e.g. Chen et al., Lab Invest., 78(2): 165-174 (1998); Gaiddon et al., Endocrinology 136(10): 4331-4338 (1995); Hall et al., Nucleic Acids Research 24(6): 1119-1126 (1996); Peterziel et al., Oncogene 18(46): 6322-6329 (1999) and O'Brian, Oncol. Rep. 5(2): 305-309 (1998)). Moreover, both glycosylation and myristoylation are protein modifications also associated with cancer and cancer progression (see e.g. Dennis et al., Biochem. Biophys. Acta 1473(1):21-34 (1999); Raju et al., Exp. Cell Res. 235(1): 145-154 (1997)). Amidation is another protein modification also associated with cancer and cancer progression (see e.g. Treston et al., J. Natl. Cancer Inst. Monogr. (13): 169-175 (1992)).

In another embodiment, proteins of the invention comprise one or more of the immunoreactive epitopes identified in accordance with art-accepted methods, such as the peptides set forth in Tables VIII-XXI and XXII-XLIX. CTL epitopes can be determined using specific algorithms to identify peptides within a 98P4B6 protein that are capable of optimally binding to specified HLA alleles (e.g., Table IV; Epimatrix™ and Epimer™, Brown University; and BIMAS). Moreover, processes for identifying peptides that have sufficient binding affinity for HLA molecules and which are correlated with being immunogenic epitopes, are well known in the art, and are carried out without undue experimentation. In addition, processes for identifying peptides that are immunogenic epitopes, are well known in the art, and are carried out without undue experimentation either in vitro or in vivo.

Also known in the art are principles for creating analogs of such epitopes in order to modulate immunogenicity. For example, one begins with an epitope that bears a CTL or HTL motif (see, e.g., the HLA Class I and HLA Class II motifs/supermotifs of Table IV). The epitope is analoged by substituting out an amino acid at one of the specified positions, and replacing it with another amino acid specified for that position. For example, on the basis of residues defined in Table IV, one can substitute out a deleterious residue in favor of any other residue, such as a preferred residue; substitute a less-preferred residue with a preferred residue; or substitute an originally-occurring preferred residue with another preferred residue. Substitutions can occur at primary anchor positions or at other positions in a peptide; see, e.g., Table IV.

A variety of references reflect the art regarding the identification and generation of epitopes in a protein of interest as well as analogs thereof. See, for example, WO 97/33602 to Chesnut et al. Sette, Immunogenetics 1999 50(3-4): 201-212; Sette et al., J. Immunol. 2001 166(2): 1389-1397; Sidney et al., Hum. Immunol. 1997 58(1): 12-20; Kondo et al., Immunogenetics 1997 45(4): 249-258; Sidney et al., J. Immunol. 1996 157(8): 3480-90; and Falk et al., Nature 351: 290-6 (1991); Hunt et al., Science 255:1261-3 (1992); Parker et al., J. Immunol. 149:3580-7 (1992); Parker et al., J. Immunol. 152:163-75 (1994)); Kast et al., 1994 152(8): 3904-12; Borras-Cuesta et al., Hum. Immunol. 2000 61(3): 266-278; Alexander et al., J. Immunol. 2000 164(3); 164(3): 1625-1633; Alexander et al., PMID: 7895164, UI: 95202582; O'Sullivan et al., J. Immunol. 1991 147(8): 2663-2669; Alexander et al., Immunity 1994 1(9): 751-761 and Alexander et al., Immunol. Res. 1998 18(2): 79-92.

Related embodiments of the invention include polypeptides comprising combinations of the different motifs set forth in Table VI, and/or, one or more of the predicted CTL epitopes of Tables VIII-XXI and XXII-XLIX, and/or, one or more of the predicted HTL epitopes of Tables XLVI-XLIX, and/or, one or more of the T cell binding motifs known in the art. Preferred embodiments contain no insertions, deletions or substitutions either within the motifs or within the intervening sequences of the polypeptides. In addition, embodiments which include a number of either N-terminal and/or C-terminal amino acid residues on either side of these motifs may be desirable (to, for example, include a greater portion of the polypeptide architecture in which the motif is located). Typically, the number of N-terminal and/or C-terminal amino acid residues on either side of a motif is between about 1 to about 100 amino acid residues, preferably 5 to about 50 amino acid residues.

98P4B6-related proteins are embodied in many forms, preferably in isolated form. A purified 98P4B6 protein molecule will be substantially free of other proteins or molecules that impair the binding of 98P4B6 to antibody, T cell or other ligand. The nature and degree of isolation and purification will depend on the intended use. Embodiments of a 98P4B6-related proteins include purified 98P4B6-related proteins and functional, soluble 98P4B6-related proteins. In one embodiment, a functional, soluble 98P4B6 protein or fragment thereof retains the ability to be bound by antibody, T cell or other ligand.

The invention also provides 98P4B6 proteins comprising biologically active fragments of a 98P4B6 amino acid sequence shown in FIG. 2 or FIG. 3. Such proteins exhibit properties of the starting 98P4B6 protein, such as the ability to elicit the generation of antibodies that specifically bind an epitope associated with the starting 98P4B6 protein; to be bound by such antibodies; to elicit the activation of HTL or CTL; and/or, to be recognized by HTL or CTL that also specifically bind to the starting protein.

98P4B6-related polypeptides that contain particularly interesting structures can be predicted and/or identified using various analytical techniques well known in the art, including, for example, the methods of Chou-Fasman, Garnier-Robson, Kyte-Doolittle, Eisenberg, Karplus-Schultz or Jameson-Wolf analysis, or based on immunogenicity. Fragments that contain such structures are particularly useful in generating subunit-specific ant-98P4B6 antibodies or T cells or in identifying cellular factors that bind to 98P4B6. For example, hydrophilicity profiles can be generated, and immunogenic peptide fragments identified, using the method of Hopp, T. P. and Woods, K. R., 1981, Proc. Natl. Acad. Sci. U.S.A. 78:3824-3828. Hydropathicity profiles can be generated, and immunogenic peptide fragments identified, using the method of Kyte, J. and Doolittle, R. F., 1982, J. Mol. Biol. 157:105-132. Percent (%) Accessible Residues profiles can be generated, and immunogenic peptide fragments identified, using the method of Janin J., 1979, Nature 277:491-492. Average Flexibility profiles can be generated, and immunogenic peptide fragments identified, using the method of Bhaskaran R., Ponnuswamy P. K., 1988, Int. J. Pept. Protein Res. 32:242-255. Beta-turn profiles can be generated, and immunogenic peptide fragments identified, using the method of Deleage, G., Roux B., 1987, Protein Engineering 1:289-294.

CTL epitopes can be determined using specific algorithms to identify peptides within a 98P4B6 protein that are capable of optimally binding to specified HLA alleles (e.g., by using the SYFPEITHI site; the listings in Table IV(A)-(E); Epimatrix™ and Epimer™, Brown University; and BIMAS. Illustrating this, peptide epitopes from 98P4B6 that are presented in the context of human MHC Class I molecules, e.g., HLA-A1, A2, A3, A11, A24, B7 and B35 were predicted (see, e.g., Tables VIII-XXI, XXII-XLIX). Specifically, the complete amino acid sequence of the 98P4B6 protein and relevant portions of other variants, i.e., for HLA Class I predictions 9 flanking residues on either side of a point mutation or exon juction, and for HLA Class II predictions 14 flanking residues on either side of a point mutation or exon junction corresponding to that variant, were entered into the HLA Peptide Motif Search algorithm found in the Bioinformatics and Molecular Analysis Section (BIMAS) web site listed above; in addition to the site SYFPEITHI.

The HLA peptide motif search algorithm was developed by Dr. Ken Parker based on binding of specific peptide sequences in the groove of HLA Class I molecules, in particular HLA-A2 (see, e.g., Falk et al., Nature 351: 290-6 (1991); Hunt et al., Science 255:1261-3 (1992); Parker et al., J. Immunol. 149:3580-7 (1992); Parker et al., J. Immunol. 152:163-75 (1994)). This algorithm allows location and ranking of 8-mer, 9-mer, and 10-mer peptides from a complete protein sequence for predicted binding to HLA-A2 as well as numerous other HLA Class I molecules. Many HLA class I binding peptides are 8-, 9-, 10 or 11-mers. For example, for Class I HLA-A2, the epitopes preferably contain a leucine (L) or methionine (M) at position 2 and a valine (V) or leucine (L) at the C-terminus (see, e.g., Parker et al., J. Immunol. 149: 3580-7 (1992)). Selected results of 98P4B6 predicted binding peptides are shown in Tables VIII-XXI and XXII-XLIX herein. In Tables VIII-XXI and XXII-XLVII, selected candidates, 9-mers and 10-mers, for each family member are shown along with their location, the amino acid sequence of each specific peptide, and an estimated binding score. In Tables XLVI-XLIX, selected candidates, 15-mers, for each family member are shown along with their location, the amino acid sequence of each specific peptide, and an estimated binding score. The binding score corresponds to the estimated half time of dissociation of complexes containing the peptide at 37° C. at pH 6.5. Peptides with the highest binding score are predicted to be the most tightly bound to HLA Class I on the cell surface for the greatest period of time and thus represent the best immunogenic targets for T-cell recognition.

Actual binding of peptides to an HLA allele can be evaluated by stabilization of HLA expression on the antigen-processing defective cell line T2 (see, e.g., Xue et al., Prostate 30:73-8 (1997) and Peshwa et al., Prostate 36:129-38 (1998)). Immunogenicity of specific peptides can be evaluated in vitro by stimulation of CD8+ cytotoxic T lymphocytes (CTL) in the presence of antigen presenting cells such as dendritic cells.

It is to be appreciated that every epitope predicted by the BIMAS site, Epimer™ and Epimatrix™ sites, or specified by the HLA class I or class II motifs available in the art or which become part of the art such as set forth in Table IV (or determined using SYFPEITHI or BIMAS) are to be "applied" to a 98P4B6 protein in accordance with the invention. As used in this context "applied" means that a 98P4B6 protein is evaluated, e.g., visually or by computer-based patterns finding methods, as appreciated by those of skill in the relevant art. Every subsequence of a 98P4B6 protein of 8, 9, 10, or 11 amino acid residues that bears an HLA Class I motif, or a subsequence of 9 or more amino acid residues that bear an HLA Class II motif are within the scope of the invention.

III.B.) Expression of 98P4B6-Related Proteins

In an embodiment described in the examples that follow, 98P4B6 can be conveniently expressed in cells (such as 293T cells) transfected with a commercially available expression vector such as a CMV-driven expression vector encoding 98P4B6 with a C-terminal 6×His and MYC tag (pcDNA3.1/mycHIS, Invitrogen or Tag5, GenHunter Corporation, Nashville Tenn.). The Tag5 vector provides an IgGK secretion signal that can be used to facilitate the production of a secreted 98P4B6 protein in transfected cells. The secreted HIS-tagged 98P4B6 in the culture media can be purified, e.g., using a nickel column using standard techniques.

III.C.) Modifications of 98P4B6-Related Proteins

Modifications of 98P4B6-related proteins such as covalent modifications are included within the scope of this invention. One type of covalent modification includes reacting targeted amino acid residues of a 98P4B6 polypeptide with an organic derivatizing agent that is capable of reacting with selected side chains or the N- or C-terminal residues of a 98P4B6 protein. Another type of covalent modification of a 98P4B6 polypeptide included within the scope of this invention comprises altering the native glycosylation pattern of a protein of the invention. Another type of covalent modification of 98P4B6 comprises linking a 98P4B6 polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337.

The 98P4B6-related proteins of the present invention can also be modified to form a chimeric molecule comprising 98P4B6 fused to another, heterologous polypeptide or amino acid sequence. Such a chimeric molecule can be synthesized chemically or recombinantly. A chimeric molecule can have a protein of the invention fused to another tumor-associated antigen or fragment thereof. Alternatively, a protein in accordance with the invention can comprise a fusion of fragments of a 98P4B6 sequence (amino or nucleic acid) such that a molecule is created that is not, through its length, directly homologous to the amino or nucleic acid sequences shown in FIG. 2 or FIG. 3. Such a chimeric molecule can comprise multiples of the same subsequence of 98P4B6. A chimeric molecule can comprise a fusion of a 98P4B6-related protein with a polyhistidine epitope tag, which provides an epitope to which immobilized nickel can selectively bind, with cytokines or with growth factors. The epitope tag is generally placed at the amino- or carboxyl-terminus of a 98P4B6 protein. In an alternative embodiment, the chimeric molecule can comprise a fusion of a 98P4B6-related protein with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a 98P4B6 polypeptide in place of at least one variable region within an Ig molecule. In a preferred embodiment, the immunoglobulin fusion includes the hinge, CH2 and CH3, or the hinge, CHI, CH2 and CH3 regions of an IgGI molecule. For the production of immunoglobulin fusions see, e.g., U.S. Pat. No. 5,428,130 issued Jun. 27, 1995.

III.D.) Uses of 98P4B6-Related Proteins

The proteins of the invention have a number of different specific uses. As 98P4B6 is highly expressed in prostate and other cancers, 98P4B6-related proteins are used in methods that assess the status of 98P4B6 gene products in normal versus cancerous tissues, thereby elucidating the malignant phenotype. Typically, polypeptides from specific regions of a 98P4B6 protein are used to assess the presence of perturbations (such as deletions, insertions, point mutations etc.) in those regions (such as regions containing one or more motifs). Exemplary assays utilize antibodies or T cells targeting 98P4B6-related proteins comprising the amino acid residues of one or more of the biological motifs contained within a 98P4B6 polypeptide sequence in order to evaluate the characteristics of this region in normal versus cancerous tissues or to elicit an immune response to the epitope. Alternatively, 98P4B6-related proteins that contain the amino acid residues of one or more of the biological motifs in a 98P4B6 protein are used to screen for factors that interact with that region of 98P4B6.

98P4B6 protein fragments/subsequences are particularly useful in generating and characterizing domain-specific antibodies (e.g., antibodies recognizing an extracellular or intracellular epitope of a 98P4B6 protein), for identifying agents or cellular factors that bind to 98P4B6 or a particular structural domain thereof, and in various therapeutic and diagnostic contexts, including but not limited to diagnostic assays, cancer vaccines and methods of preparing such vaccines.

Proteins encoded by the 98P4B6 genes, or by analogs, homologs or fragments thereof, have a variety of uses, including but not limited to generating antibodies and in methods for identifying ligands and other agents and cellular constituents that bind to a 98P4B6 gene product. Antibodies raised against a 98P4B6 protein or fragment thereof are useful in diagnostic and prognostic assays, and imaging methodologies in the management of human cancers characterized by expression of 98P4B6 protein, such as those listed in Table I. Such antibodies can be expressed intracellularly and used in methods of treating patients with such cancers. 98P4B6-related nucleic acids or proteins are also used in generating HTL or CTL responses.

Various immunological assays useful for the detection of 98P4B6 proteins are used, including but not limited to various types of radioimmunoassays, enzyme-linked immunosorbent assays (ELISA), enzyme-linked immunofluorescent assays (ELIFA), immunocytochemical methods, and the like. Antibodies can be labeled and used as immunological imaging reagents capable of detecting 98P4B6-expressing cells (e.g., in radioscintgraphic imaging methods). 98P4B6 proteins are also particularly useful in generating cancer vaccines, as further described herein.

IV.) 98P4B6 Antibodies

Another aspect of the invention provides antibodies that bind to 98P4B6-related proteins. Preferred antibodies specifically bind to a 98P4B6-related protein and do not bind (or bind weakly) to peptides or proteins that are not 98P4B6-related proteins under physiological conditions. In this context, examples of physiological conditions include: 1) phosphate buffered saline; 2) Tris-buffered saline containing 25 mM Tris and 150 mM NaCl; or normal saline (0.9% NaCl); 4) animal serum such as human serum; or, 5) a combination of any of 1) through 4); these reactions preferably taking place at pH 7.5, alternatively in a range of pH 7.0 to 8.0, or alternatively in a range of pH 6.5 to 8.5; also, these reactions taking place at a temperature between 4° C. to 37° C. For example, antibodies that bind 98P4B6 can bind 98P4B6-related proteins such as the homologs or analogs thereof.

98P4B6 antibodies of the invention are particularly useful in cancer (see, e.g., Table I) diagnostic and prognostic assays, and imaging methodologies. Similarly, such antibodies are useful in the treatment, diagnosis, and/or prognosis of other cancers, to the extent 98P4B6 is also expressed or overexpressed in these other cancers. Moreover, intracellularly expressed antibodies (e.g., single chain antibodies) are therapeutically useful in treating cancers in which the expression of 98P4B6 is involved, such as advanced or metastatic prostate cancers.

The invention also provides various immunological assays useful for the detection and quantification of 98P4B6 and mutant 98P4B6-related proteins. Such assays can comprise one or more 98P4B6 antibodies capable of recognizing and binding a 98P4B6-related protein, as appropriate. These assays are performed within various immunological assay formats well known in the art, including but not limited to various types of radioimmunoassays, enzyme-linked immunosorbent assays (ELISA), enzyme-linked immunofluorescent assays (ELIFA), and the like.

Immunological non-antibody assays of the invention also comprise T cell immunogenicity assays (inhibitory or stimulatory) as well as major histocompatibility complex (MHC) binding assays.

In addition, immunological imaging methods capable of detecting prostate cancer and other cancers expressing 98P4B6 are also provided by the invention, including but not limited to radioscintigraphic imaging methods using labeled 98P4B6 antibodies. Such assays are clinically useful in the detection, monitoring, and prognosis of 98P4B6 expressing cancers such as prostate cancer.

98P4B6 antibodies are also used in methods for purifying a 98P4B6-related protein and for isolating 98P4B6 homologues and related molecules. For example, a method of purifying a 98P4B6-related protein comprises incubating a 98P4B6 antibody, which has been coupled to a solid matrix, with a lysate or other solution containing a 98P4B6-related protein under conditions that permit the 98P4B6 antibody to bind to the 98P4B6-related protein; washing the solid matrix to eliminate impurities; and eluting the 98P4B6-related protein from the coupled antibody. Other uses of 98P4B6 antibodies in accordance with the invention include generating anti-idiotypic antibodies that mimic a 98P4B6 protein.

Various methods for the preparation of antibodies are well known in the art. For example, antibodies can be prepared by immunizing a suitable mammalian host using a 98P4B6-related protein, peptide, or fragment, in isolated or immunoconjugated form (Antibodies: A Laboratory Manual, CSH Press, Eds., Harlow, and Lane (1988); Harlow, Antibodies, Cold Spring Harbor Press, NY (1989)). In addition, fusion proteins of 98P4B6 can also be used, such as a 98P4B6 GST-fusion protein. In a particular embodiment, a GST fusion protein comprising all or most of the amino acid sequence of FIG. 2 or FIG. 3 is produced, then used as an immunogen to generate appropriate antibodies. In another embodiment, a 98P4B6-related protein is synthesized and used as an immunogen.

In addition, naked DNA immunization techniques known in the art are used (with or without purified 98P4B6-related protein or 98P4B6 expressing cells) to generate an immune response to the encoded immunogen (for review, see Donnelly et al., 1997, Ann. Rev. Immunol. 15: 617-648).

The amino acid sequence of a 98P4B6 protein as shown in FIG. 2 or FIG. 3 can be analyzed to select specific regions of the 98P4B6 protein for generating antibodies. For example, hydrophobicity and hydrophilicity analyses of a 98P4B6 amino acid sequence are used to identify hydrophilic regions in the 98P4B6 structure. Regions of a 98P4B6 protein that show immunogenic structure, as well as other regions and domains, can readily be identified using various other methods known in the art, such as Chou-Fasman, Garnier-Robson, Kyte-Doolittle, Eisenberg, Karplus-Schultz or Jameson-Wolf analysis. Hydrophilicity profiles can be generated using the method of Hopp, T. P. and Woods, K. R., 1981, Proc. Natl. Acad. Sci. U.S.A. 78:3824-3828. Hydropathicity profiles can be generated using the method of Kyte, J. and Doolittle, R. F., 1982, J. Mol. Biol. 157:105-132. Percent (%) Accessible Residues profiles can be generated using the method of Janin J., 1979, Nature 277:491-492. Average Flexibility profiles can be generated using the method of Bhaskaran R., Ponnuswamy P. K., 1988, Int. J. Pept. Protein Res. 32:242-255. Beta-turn profiles can be generated using the method of Deleage, G., Roux B., 1987, Protein Engineering 1:289-294. Thus, each region identified by any of these programs or methods is within the scope of the present invention. Methods for the generation of 98P4B6 antibodies are further illustrated by way of the examples provided herein. Methods for preparing a protein or polypeptide for use as an immunogen are well known in the art. Also well known in the art are methods for preparing immunogenic conjugates of a protein with a carrier, such as BSA, KLH or other carrier protein. In some circumstances, direct conjugation using, for example, carbodiimide reagents are used; in other instances linking reagents such as those supplied by Pierce Chemical Co., Rockford, Ill., are effective. Administration of a 98P4B6 immunogen is often conducted by injection over a suitable time period and with use of a suitable adjuvant, as is understood in the art. During the immunization schedule, titers of antibodies can be taken to determine adequacy of antibody formation.

98P4B6 monoclonal antibodies can be produced by various means well known in the art. For example, immortalized cell lines that secrete a desired monoclonal antibody are prepared using the standard hybridoma technology of Kohler and Milstein or modifications that immortalize antibody-producing B cells, as is generally known. Immortalized cell lines that secrete the desired antibodies are screened by immunoassay in which the antigen is a 98P4B6-related protein. When the appropriate immortalized cell culture is identified, the cells can be expanded and antibodies produced either from in vitro cultures or from ascites fluid.

The antibodies or fragments of the invention can also be produced, by recombinant means. Regions that bind specifically to the desired regions of a 98P4B6 protein can also be produced in the context of chimeric or complementarity-determining region (CDR) grafted antibodies of multiple species origin. Humanized or human 98P4B6 antibodies can also be produced, and are preferred for use in therapeutic contexts. Methods for humanizing murine and other non-human antibodies, by substituting one or more of the non-human antibody CDRs for corresponding human antibody sequences, are well known (see for example, Jones et al., 1986, Nature 321: 522-525; Riechmann et al., 1988, Nature 332: 323-327; Verhoeyen et al., 1988, Science 239: 1534-1536). See also, Carter et al., 1993, Proc. Natl. Acad. Sci. USA 89: 4285 and Sims et al., 1993, J. Immunol. 151: 2296.

Methods for producing fully human monoclonal antibodies include phage display and transgenic methods (for review, see Vaughan et al., 1998, Nature Biotechnology 16: 535-539). Fully human 98P4B6 monoclonal antibodies can be generated using cloning technologies employing large human Ig gene combinatorial libraries (i.e., phage display) (Griffiths and Hoogenboom, Building an in vitro immune system: human antibodies from phage display libraries. In: Protein Engineering of Antibody Molecules for Prophylactic and Therapeutic Applications in Man, Clark, M. (Ed.), Nottingham Academic, pp 45-64 (1993); Burton and Barbas, Human Antibodies from combinatorial libraries. Id., pp 65-82). Fully human 98P4B6 monoclonal antibodies can also be produced using transgenic mice engineered to contain human immunoglobulin gene loci as described in PCT Patent Application WO98/24893, Kucherlapati and Jakobovits et al., published Dec. 3, 1997 (see also, Jakobovits, 1998, Exp. Opin. Invest. Drugs 7(4): 607-614; U.S. Pat. No. 6,162,963 issued 19 Dec. 2000; U.S. Pat. No. 6,150,584 issued 12 Nov. 2000; and, U.S. Pat. No. 6,114,598 issued 5 Sep. 2000). This method avoids the in vitro manipulation required with phage display technology and efficiently produces high affinity authentic human antibodies.

Reactivity of 98P4B6 antibodies with a 98P4B6-related protein can be established by a number of well known means, including Western blot, immunoprecipitation, ELISA, and FACS analyses using, as appropriate, 98P4B6-related proteins, 98P4B6-expressing cells or extracts thereof. A 98P4B6 antibody or fragment thereof can be labeled with a detectable marker or conjugated to a second molecule. Suitable detectable markers include, but are not limited to, a radioisotope, a fluorescent compound, a bioluminescent compound, chemiluminescent compound, a metal chelator or an enzyme. Further, bi-specific antibodies specific for two or more 98P4B6 epitopes are generated using methods generally known in the art. Homodimeric antibodies can also be generated by cross-linking techniques known in the art (e.g., Wolff et al., Cancer Res. 53: 2560-2565).

V.) 98P4B6 Cellular Immune Responses

The mechanism by which T cells recognize antigens has been delineated. Efficacious peptide epitope vaccine compositions of the invention induce a therapeutic or prophylactic immune responses in very broad segments of the world-wide population. For an understanding of the value and efficacy of compositions of the invention that induce cellular immune responses, a brief review of immunology-related technology is provided.

A complex of an HLA molecule and a peptidic antigen acts as the ligand recognized by HLA-restricted T cells (Buus, S. et al., Cell 47:1071, 1986; Babbitt, B. P. et al., Nature 317: 359, 1985; Townsend, A. and Bodmer, H., Annu. Rev. Immunol. 7:601, 1989; Germain, R. N., Annu. Rev. Immunol. 11:403,1993). Through the study of single amino acid substituted antigen analogs and the sequencing of endogenously bound, naturally processed peptides, critical residues that correspond to motifs required for specific binding to HLA antigen molecules have been identified and are set forth in Table IV (see also, e.g., Southwood, et al., J. Immunol. 160: 3363,1998; Rammensee, et al., Immunogenetics 41:178,1995; Rammensee et al., SYFPEITHI; Sette, A. and Sidney, J. Curr. Opin. Immunol. 10:478, 1998; Engelhard, V. H., Curr. Opin. Immunol. 6:13,1994; Sette, A. and Grey, H. M., Curr. Opin. Immunol. 4:79,1992; Sinigaglia, F. and Hammer, J. Curr. Biol. 6:52, 1994; Ruppert et al., Cell 74:929-937, 1993; Kondo et al., J. Immunol. 155:4307-4312, 1995; Sidney et al., *J. Immunol.* 157:3480-3490, 1996; Sidney et al., *Human Immunol.* 45:79-93, 1996; Sette, A. and Sidney, J. Immunogenetics 1999 November; 50(34):201-12, Review).

Furthermore, x-ray crystallographic analyses of HLA-peptide complexes have revealed pockets within the peptide binding cleft/groove of HLA molecules which accommodate, in an allele-specific mode, residues borne by peptide ligands; these residues in turn determine the HLA binding capacity of the peptides in which they are present. (See, e.g., Madden, D. R. *Annu. Rev. Immunol.* 13:587,1995; Smith, et al., *Immunity* 4:203, 1996; Fremont et al., *Immunity* 8:305, 1998; Stern et al., *Structure* 2:245, 1994; Jones, E. Y. *Curr. Opin. Immunol* 9:75, 1997; Brown, J. H. et al., *Nature* 364:33, 1993; Guo, H. C. et al., *Proc. Natl. Acad. Sci. USA* 90:8053, 1993; Guo, H. C. et al., *Nature* 360:364, 1992; Silver, M. L. et al., *Nature* 360:367, 1992; Matsumura, M. et al., *Science* 257:927, 1992; Madden et al., *Cell* 70:1035, 1992; Fremont, D. H. et al., *Science* 257:919, 1992; Saper, M. A., Bjorkman, P. J. and Wiley, D. C., *J. Mol. Biol.* 219:277, 1991.)

Accordingly, the definition of class I and class II allele-specific HLA binding motifs, or class I or class II supermotifs allows identification of regions within a protein that are correlated with binding to particular HLA antigen(s).

Thus, by a process of HLA motif identification, candidates for epitope-based vaccines have been identified; such candidates can be further evaluated by HLA-peptide binding assays to determine binding affinity and/or the time period of association of the epitope and its corresponding HLA molecule. Additional confirmatory work can be performed to select, amongst these vaccine candidates, epitopes with preferred characteristics in terms of population coverage, and/or immunogenicity.

Various strategies can be utilized to evaluate cellular immunogenicity, including:

1) Evaluation of primary T cell cultures from normal individuals (see, e.g., Wentworth, P. A. et al., *Mol. Immunol.* 32:603, 1995; Celis, E. et al., *Proc. Natl. Acad. Sci. USA* 91:2105, 1994; Tsai, V. et al., *J. Immunol.* 158:1796, 1997; Kawashima, I. et al., *Human Immunol.* 59:1, 1998). This procedure involves the stimulation of peripheral blood lymphocytes (PBL) from normal subjects with a test peptide in the presence of antigen presenting cells in vitro over a period of several weeks. T cells specific for the peptide become activated during this time and are detected using, e.g., a lymphokine- or $^{51}$Cr-release assay involving peptide sensitized target cells.

2) Immunization of HLA transgenic mice (see, e.g., Wentworth, P. A. et al., *J. Immunol.* 26:97, 1996; Wentworth, P. A. et al., *Int. Immunol.* 8:651, 1996; Alexander, J. et al., *J. Immunol.* 159:4753, 1997). For example, in such methods peptides in incomplete Freund's adjuvant are administered subcutaneously to HLA transgenic mice. Several weeks following immunization, splenocytes are removed and cultured in vitro in the presence of test peptide for approximately one week. Peptide-specific T cells are detected using, e.g., a $^{51}$ Cr-release assay involving peptide sensitized target cells and target cells expressing endogenously generated antigen.

3) Demonstration of recall T cell responses from immune individuals who have been either effectively vaccinated and/or from chronically ill patients (see, e.g., Rehermann, B. et al., *J. Exp. Med.* 181:1047, 1995; Doolan, D. L. et al., *Immunity* 7:97, 1997; Bertoni, R. et al., *J. Clin. Invest.* 100:503, 1997; Threlkeld, S. C. et al., *J. Immunol.* 159:1648, 1997; Diepolder, H. M. et al., *J. Virol.* 71:6011, 1997). Accordingly, recall responses are detected by culturing PBL from subjects that have been exposed to the antigen due to disease and thus have generated an immune response "naturally", or from patients who were vaccinated against the antigen. PBL from subjects are cultured in vitro for 1-2 weeks in the presence of test peptide plus antigen presenting cells (APC) to allow activation of "memory" T cells, as compared to "naive" T cells. At the end of the culture period, T cell activity is detected using assays including $^{51}$ Cr release involving peptide-sensitized targets, T cell proliferation, or lymphokine release.

VI.) 98P4B6 Transgenic Animals

Nucleic acids that encode a 98P4B6-related protein can also be used to generate either transgenic animals or "knock out" animals that, in turn, are useful in the development and screening of therapeutically useful reagents. In accordance with established techniques, cDNA encoding 98P4B6 can be used to clone genomic DNA that encodes 98P4B6. The cloned genomic sequences can then be used to generate transgenic animals containing cells that express DNA that encode 98P4B6. Methods for generating transgenic animals, particularly animals such as mice or rats, have become conventional in the art and are described, for example, in U.S. Pat. No. 4,736,866 issued 12 Apr. 1988, and U.S. Pat. No. 4,870,009 issued 26 Sep. 1989. Typically, particular cells would be targeted for 98P4B6 transgene incorporation with tissue-specific enhancers.

Transgenic animals that include a copy of a transgene encoding 98P4B6 can be used to examine the effect of increased expression of DNA that encodes 98P4B6. Such animals can be used as tester animals for reagents thought to confer protection from, for example, pathological conditions associated with its overexpression. In accordance with this aspect of the invention, an animal is treated with a reagent and a reduced incidence of a pathological condition, compared to untreated animals that bear the transgene, would indicate a potential therapeutic intervention for the pathological condition.

Alternatively, non-human homologues of 98P4B6 can be used to construct a 98P4B6 "knock out" animal that has a defective or altered gene encoding 98P4B6 as a result of homologous recombination between the endogenous gene encoding 98P4B6 and altered genomic DNA encoding 98P4B6 introduced into an embryonic cell of the animal. For example, cDNA that encodes 98P4B6 can be used to clone genomic DNA encoding 98P4B6 in accordance with established techniques. A portion of the genomic DNA encoding 98P4B6 can be deleted or replaced with another gene, such as a gene encoding a selectable marker that can be used to monitor integration. Typically, several kilobases of unaltered flanking DNA (both at the 5' and 3' ends) are included in the vector (see, e.g., Thomas and Capecchi, *Cell,* 51:503 (1987) for a description of homologous recombination vectors). The vector is introduced into an embryonic stem cell line (e.g., by electroporation) and cells in which the introduced DNA has homologously recombined with the endogenous DNA are selected (see, e.g., Li et al., *Cell,* 69:915 (1992)). The selected cells are then injected into a blastocyst of an animal (e.g., a mouse or rat) to form aggregation chimeras (see, e.g., Bradley, in *Teratocarcinomas and Embryonic Stem Cells: A Practical Approach,* E. J. Robertson, ed. (IRL, Oxford, 1987), pp. 113-152). A chimeric embryo can then be implanted into a suitable pseudopregnant female foster animal, and the embryo brought to term to create a "knock out" animal. Progeny harboring the homologously recombined DNA in their germ cells can be identified by standard techniques and used to breed animals in which all cells of the animal contain the homologously recombined DNA. Knock out animals can be characterized, for example, for their ability to defend against certain pathological conditions or for their development of pathological conditions due to absence of a 98P4B6 polypeptide.

VII.) Methods for the Detection of 98P4B6

Another aspect of the present invention relates to methods for detecting 98P4B6 polynucleotides and 98P4B6-related proteins, as well as methods for identifying a cell that expresses 98P4B6. The expression profile of 98P4B6 makes it a diagnostic marker for metastasized disease. Accordingly, the status of 98P4B6 gene products provides information useful for predicting a variety of factors including susceptibility to advanced stage disease, rate of progression, and/or tumor aggressiveness. As discussed in detail herein, the status of 98P4B6 gene products in patient samples can be analyzed by a variety protocols that are well known in the art including immunohistochemical analysis, the variety of Northern blotting techniques including in situ hybridization, RT-PCR analysis (for example on laser capture micro-dissected samples), Western blot analysis and tissue array analysis.

More particularly, the invention provides assays for the detection of 98P4B6 polynucleotides in a biological sample, such as serum, bone, prostate, and other tissues, urine, semen, cell preparations, and the like. Detectable 98P4B6 polynucleotides include, for example, a 98P4B6 gene or fragment thereof, 98P4B6 mRNA, alternative splice variant 98P4B6 mRNAs, and recombinant DNA or RNA molecules that contain a 98P4B6 polynucleotide. A number of methods for amplifying and/or detecting the presence of 98P4B6 polynucleotides are well known in the art and can be employed in the practice of this aspect of the invention.

In one embodiment, a method for detecting a 98P4B6 mRNA in a biological sample comprises producing cDNA from the sample by reverse transcription using at least one primer; amplifying the cDNA so produced using a 98P4B6 polynucleotides as sense and antisense primers to amplify 98P4B6 cDNAs therein; and detecting the presence of the amplified 98P4B6 cDNA. Optionally, the sequence of the amplified 98P4B6 cDNA can be determined.

In another embodiment, a method of detecting a 98P4B6 gene in a biological sample comprises first isolating genomic DNA from the sample; amplifying the isolated genomic DNA using 98P4B6 polynucleotides as sense and antisense primers; and detecting the presence of the amplified 98P4B6 gene. Any number of appropriate sense and antisense probe combinations can be designed from a 98P4B6 nucleotide sequence (see, e.g., FIG. 2) and used for this purpose.

The invention also provides assays for detecting the presence of a 98P4B6 protein in a tissue or other biological sample such as serum, semen, bone, prostate, urine, cell preparations, and the like. Methods for detecting a 98P4B6-related protein are also well known and include, for example, immunoprecipitation, immunohistochemical analysis, Western blot analysis, molecular binding assays, ELISA, ELIFA and the like. For example, a method of detecting the presence of a 98P4B6-related protein in a biological sample comprises first contacting the sample with a 98P4B6 antibody, a 98P4B6-reactive fragment thereof, or a recombinant protein containing an antigen-binding region of a 98P4B6 antibody; and then detecting the binding of 98P4B6-related protein in the sample.

Methods for identifying a cell that expresses 98P4B6 are also within the scope of the invention. In one embodiment, an assay for identifying a cell that expresses a 98P4B6 gene comprises detecting the presence of 98P4B6 mRNA in the cell. Methods for the detection of particular mRNAs in cells are well known and include, for example, hybridization assays using complementary DNA probes (such as in situ hybridization using labeled 98P4B6 riboprobes, Northern blot and related techniques) and various nucleic acid amplification assays (such as RT-PCR using complementary primers specific for 98P4B6, and other amplification type detection methods, such as, for example, branched DNA, SISBA, TMA and the like). Alternatively, an assay for identifying a cell that expresses a 98P4B6 gene comprises detecting the presence of 98P4B6-related protein in the cell or secreted by the cell. Various methods for the detection of proteins are well known in the art and are employed for the detection of 98P4B6-related proteins and cells that express 98P4B6-related proteins.

98P4B6 expression analysis is also useful as a tool for identifying and evaluating agents that modulate 98P4B6 gene expression. For example, 98P4B6 expression is significantly upregulated in prostate cancer, and is expressed in cancers of the tissues listed in Table I. Identification of a molecule or biological agent that inhibits 98P4B6 expression or overexpression in cancer cells is of therapeutic value. For example, such an agent can be identified by using a screen that quantifies 98P4B6 expression by RT-PCR, nucleic acid hybridization or antibody binding.

VIII.) Methods for Monitoring the Status of 98P4B6-related Genes and Their Products Oncogenesis is known to be a multistep process where cellular growth becomes progressively dysregulated and cells progress from a normal physiological state to precancerous and then cancerous states (see, e.g., Alers et al., Lab Invest. 77(5): 437-438 (1997) and Isaacs et al., Cancer Surv. 23: 19-32 (1995)). In this context, examining a biological sample for evidence of dysregulated cell growth (such as aberrant 98P4B6 expression in cancers) allows for early detection of such aberrant physiology, before a pathologic state such as cancer has progressed to a stage that therapeutic options are more limited and or the prognosis is worse. In such examinations, the status of 98P4B6 in a biological sample of interest can be compared, for example, to the status of 98P4B6 in a corresponding normal sample (e.g. a sample from that individual or alternatively another individual that is not affected by a pathology). An alteration in the status of 98P4B6 in the biological sample (as compared to the normal sample) provides evidence of dysregulated cellular growth. In addition to using a biological sample that is not affected by a pathology as a normal sample, one can also use a predetermined normative value such as a predetermined normal level of mRNA expression (see, e.g., Grever et al., J. Comp. Neurol. 1996 Dec 9; 376(2): 306-14 and U.S. Pat. No. 5,837,501) to compare 98P4B6 status in a sample.

The term "status" in this context is used according to its art accepted meaning and refers to the condition or state of a gene and its products. Typically, skilled artisans use a number of parameters to evaluate the condition or state of a gene and its products. These include, but are not limited to the location of expressed gene products (including the location of 98P4B6 expressing cells) as well as the level, and biological activity of expressed gene products (such as 98P4B6 mRNA, polynucleotides and polypeptides). Typically, an alteration in the status of 98P4B6 comprises a change in the location of 98P4B6 and/or 98P4B6 expressing cells and/or an increase in 98P4B6 mRNA and/or protein expression.

98P4B6 status in a sample can be analyzed by a number of means well known in the art, including without limitation, immunohistochemical analysis, in situ hybridization, RT-PCR analysis on laser capture micro-dissected samples, Western blot analysis, and tissue array analysis. Typical protocols for evaluating the status of a 98P4B6 gene and gene products are found, for example in Ausubel et al. eds., 1995, Current Protocols In Molecular Biology, Units 2 (Northern Blotting), 4 (Southern Blotting), 15 (Immunoblotting) and 18 (PCR Analysis). Thus, the status of 98P4B6 in a biological sample is evaluated by various methods utilized by skilled artisans including, but not limited to genomic Southern analysis (to examine, for example perturbations in a 98P4B6 gene), Northern analysis and/or PCR analysis of 98P4B6 mRNA (to examine, for example alterations in the polynucleotide sequences or expression levels of 98P4B6 mRNAs), and, Western and/or immunohistochemical analysis (to examine, for example alterations in polypeptide sequences, alterations in polypeptide localization within a sample, alterations in expression levels of 98P4B6 proteins and/or associations of 98P4B6 proteins with polypeptide binding partners). Detectable 98P4B6 polynucleotides include, for example, a 98P4B6 gene or fragment thereof, 98P4B6 mRNA, alternative splice variants, 98P4B6 mRNAs, and recombinant DNA or RNA molecules containing a 98P4B6 polynucleotide.

The expression profile of 98P4B6 makes it a diagnostic marker for local and/or metastasized disease, and provides information on the growth or oncogenic potential of a biological sample. In particular, the status of 98P4B6 provides information useful for predicting susceptibility to particular disease stages, progression, and/or tumor aggressiveness. The invention provides methods and assays for determining 98P4B6 status and diagnosing cancers that express 98P4B6, such as cancers of the tissues listed in Table I. For example, because 98P4B6 mRNA is so highly expressed in prostate and other cancers relative to normal prostate tissue, assays that evaluate the levels of 98P4B6 mRNA transcripts or proteins in a biological sample can be used to diagnose a disease associated with 98P4B6 dysregulation, and can provide prognostic information useful in defining appropriate therapeutic options.

The expression status of 98P4B6 provides information including the presence, stage and location of dysplastic, precancerous and cancerous cells, predicting susceptibility to various stages of disease, and/or for gauging tumor aggressiveness. Moreover, the expression profile makes it useful as an imaging reagent for metastasized disease. Consequently, an aspect of the invention is directed to the various molecular prognostic and diagnostic methods for examining the status of 98P4B6 in biological samples such as those from individuals suffering from, or suspected of suffering from a pathology characterized by dysregulated cellular growth, such as cancer.

As described above, the status of 98P4B6 in a biological sample can be examined by a number of well-known procedures in the art. For example, the status of 98P4B6 in a biological sample taken from a specific location in the body can be examined by evaluating the sample for the presence or absence of 98P4B6 expressing cells (e.g. those that express 98P4B6 mRNAs or proteins). This examination can provide evidence of dysregulated cellular growth, for example, when 98P4B6-expressing cells are found in a biological sample that does not normally contain such cells (such as a lymph node), because such alterations in the status of 98P4B6 in a biological sample are often associated with dysregulated cellular growth. Specifically, one indicator of dysregulated cellular growth is the metastases of cancer cells from an organ of origin (such as the prostate) to a different area of the body (such as a lymph node). In this context, evidence of dysregulated cellular growth is important for example because occult lymph node metastases can be detected in a substantial proportion of patients with prostate cancer, and such metastases are associated with known predictors of disease progression (see, e.g., Murphy et al., Prostate 42(4): 315-317 (2000);Su et al., Semin. Surg. Oncol. 18(1): 17-28 (2000) and Freeman et al., J Urol 1995 August 154(2 Pt 1):474-8).

In one aspect, the invention provides methods for monitoring 98P4B6 gene products by determining the status of 98P4B6 gene products expressed by cells from an individual suspected of having a disease associated with dysregulated cell growth (such as hyperplasia or cancer) and then comparing the status so determined to the status of 98P4B6 gene products in a corresponding normal sample. The presence of aberrant 98P4B6 gene products in the test sample relative to the normal sample provides an indication of the presence of dysregulated cell growth within the cells of the individual.

In another aspect, the invention provides assays useful in determining the presence of cancer in an individual, comprising detecting a significant increase in 98P4B6 mRNA or protein expression in a test cell or issue sample relative to expression levels in the corresponding normal cell or tissue. The presence of 98P4B6 mRNA can, for example, be evaluated in tissues including but not limited to those listed in Table I. The presence of significant 98P4B6 expression in any of these tissues is useful to indicate the emergence, presence and/or severity of a cancer, since the corresponding normal tissues do not express 98P4B6 mRNA or express it at lower levels.

In a related embodiment, 98P4B6 status is determined at the protein level rather than at the nucleic acid level. For example, such a method comprises determining the level of 98P4B6 protein expressed by cells in a test issue sample and comparing the level so determined to the level of 98P4B6 expressed in a corresponding normal sample. In one embodiment, the presence of 98P4B6 protein is evaluated, for example, using immunohistochemical methods. 98P4B6 antibodies or binding partners capable of detecting 98P4B6 protein expression are used in a variety of assay formats well known in the art for this purpose.

In a further embodiment, one can evaluate the status of 98P4B6 nucleotide and amino acid sequences in a biological sample in order to identify perturbations in the structure of these molecules. These perturbations can include insertions, deletions, substitutions and the like. Such evaluations are useful because perturbations in the nucleotide and amino acid sequences are observed in a large number of proteins associated with a growth dysregulated phenotype (see, e.g., Marrogi et al., 1999, J. Cutan. Pathol. 26(8):369-378). For example, a mutation in the sequence of 98P4B6 may be indicative of the presence or promotion of a tumor. Such assays therefore have diagnostic and predictive value where a mutation in 98P4B6 indicates a potential loss of function or increase in tumor growth.

A wide variety of assays for observing perturbations in nucleotide and amino acid sequences are well known in the art. For example, the size and structure of nucleic acid or amino acid sequences of 98P4B6 gene products are observed by the Northern, Southern, Western, PCR and DNA sequencing protocols discussed herein. In addition, other methods for observing perturbations in nucleotide and amino acid sequences such as single strand conformation polymorphism analysis are well known in the art (see, e.g., U.S. Pat. No. 5,382,510 issued 7 Sep. 1999, and U.S. Pat. No. 5,952,170 issued 17 Jan. 1995).

Additionally, one can examine the methylation status of a 98P4B6 gene in a biological sample. Aberrant demethylation and/or hypermethylation of CpG islands in gene 5' regulatory regions frequently occurs in immortalized and transformed cells, and can result in altered expression of various genes. For example, promoter hypermethylation of the pi-class glutathione S-transferase (a protein expressed in normal prostate but not expressed in >90% of prostate carcinomas) appears to permanently silence transcription of this gene and is the most frequently detected genomic alteration in prostate carcinomas (De Marzo et al., Am. J. Pathol. 155(6): 1985-1992 (1999)). In addition, this alteration is present in at least 70% of cases of high-grade prostatic intraepithelial neoplasia (PIN) (Brooks et al., Cancer Epidemiol. Biomarkers Prev., 1998, 7:531-536). In another example, expression of the LAGE-I tumor specific gene (which is not expressed in normal prostate but is expressed in 25-50% of prostate cancers) is induced by deoxy-azacytidine in lymphoblastoid cells, suggesting that tumoral expression is due to demethylation (Lethe et al., Int. J. Cancer 76(6): 903-908 (1998)). A variety of assays for examining methylation status of a gene are well known in the art. For example, one can utilize, in Southern hybridization approaches, methylation-sensitive restriction enzymes that cannot cleave sequences that contain methylated CpG sites to assess the methylation status of CpG islands. In addition, MSP (methylation specific PCR) can rapidly profile the methylation status of all the CpG sites present in a CpG island of a given gene. This procedure involves initial modification of DNA by sodium bisulfite (which will convert all unmethylated cytosines to uracil) followed by amplification using primers specific for methylated versus unmethylated DNA. Protocols involving methylation interference can also be found for example in Current Protocols In Molecular Biology, Unit 12, Frederick M. Ausubel et al. eds., 1995.

Gene amplification is an additional method for assessing the status of 98P4B6. Gene amplification is measured in a sample directly, for example, by conventional Southern blotting or Northern blotting to quantitate the transcription of mRNA (Thomas, 1980, Proc. Natl. Acad. Sci. USA, 77:5201-5205), dot blotting (DNA analysis), or in situ hybridization, using an appropriately labeled probe, based on the sequences provided herein. Alternatively, antibodies are employed that recognize specific duplexes, including DNA duplexes, RNA duplexes, and DNA-RNA hybrid duplexes or DNA-protein duplexes. The antibodies in turn are labeled and the assay carded out where the duplex is bound to a surface, so that upon the formation of duplex on the surface, the presence of antibody bound to the duplex can be detected.

Biopsied tissue or peripheral blood can be conveniently assayed for the presence of cancer cells using for example, Northern, dot blot or RT-PCR analysis to detect 98P4B6 expression. The presence of RT-PCR amplifiable 98P4B6 mRNA provides an indication of the presence of cancer. RT-PCR assays are well known in the art. RT-PCR detection assays for tumor cells in peripheral blood are currently being evaluated for use in the diagnosis and management of a number of human solid tumors. In the prostate cancer field, these include RT-PCR assays for the detection of cells expressing PSA and PSM (Verkaik et al, 1997, Urol. Res. 25:373-384; Ghossein et al, 1995, J. Clin. Oncol. 13:1195-2000; Heston et al, 1995, Clin. Chem. 41:1687-1688).

A further aspect of the invention is an assessment of the susceptibility that an individual has for developing cancer. In one embodiment, a method for predicting susceptibility to cancer comprises detecting 98P4B6 mRNA or 98P4B6 protein in a tissue sample, its presence indicating susceptibility to cancer, wherein the degree of 98P4B6 mRNA expression correlates to the degree of susceptibility. In a specific embodiment, the presence of 98P4B6 in prostate or other tissue is examined, with the presence of 98P4B6 in the sample providing an indication of prostate cancer susceptibility (or the emergence or existence of a prostate tumor). Similarly, one can evaluate the integrity 98P4B6 nucleotide and amino acid sequences in a biological sample, in order to identify perturbations in the structure of these molecules such as insertions, deletions, substitutions and the like. The presence of one or more perturbations in 98P4B6 gene products in the sample is an indication of cancer susceptibility (or the emergence or existence of a tumor).

The invention also comprises methods for gauging tumor aggressiveness. In one embodiment, a method for gauging aggressiveness of a tumor comprises determining the level of 98P4B6 mRNA or 98P4B6 protein expressed by tumor cells, comparing the level so determined to the level of 98P4B6 mRNA or 98P4B6 protein expressed in a corresponding normal tissue taken from the same individual or a normal tissue reference sample, wherein the degree of 98P4B6 mRNA or 98P4B6 protein expression in the tumor sample relative to the normal sample indicates the degree of aggressiveness. In a specific embodiment, aggressiveness of a tumor is evaluated by determining the extent to which 98P4B6 is expressed in the tumor cells, with higher expression levels indicating more aggressive tumors. Another embodiment is the evaluation of the integrity of 98P4B6 nucleotide and amino acid sequences in a biological sample, in order to identify perturbations in the structure of these molecules such as insertions, deletions, substitutions and the like. The presence of one or more perturbations indicates more aggressive tumors.

Another embodiment of the invention is directed to methods for observing the progression of a malignancy in an individual over time. In one embodiment, methods for observing the progression of a malignancy in an individual over time comprise determining the level of 98P4B6 mRNA or 98P4B6 protein expressed by cells in a sample of the tumor, comparing the level so determined to the level of 98P4B6 mRNA or 98P4B6 protein expressed in an equivalent tissue sample taken from the same individual at a different time, wherein the degree of 98P4B6 mRNA or 98P4B6 protein expression in the tumor sample over time provides information on the progression of the cancer. In a specific embodiment, the progression of a cancer is evaluated by determining 98P4B6 expression in the tumor cells over time, where increased expression over time indicates a progression of the cancer. Also, one can evaluate the integrity 98P4B6 nucleotide and amino acid sequences in a biological sample in order to identify perturbations in the structure of these molecules such as insertions, deletions, substitutions and the like, where the presence of one or more perturbations indicates a progression of the cancer.

The above diagnostic approaches can be combined with any one of a wide variety of prognostic and diagnostic protocols known in the art. For example, another embodiment of the invention is directed to methods for observing a coincidence between the expression of 98P4B6 gene and 98P4B6 gene products (or perturbations in 98P4B6 gene and 98P4B6 gene products) and a factor that is associated with malignancy, as a means for diagnosing and prognosticating the status of a issue sample. A wide variety of factors associated with malignancy can be utilized, such as the expression of genes associated with malignancy (e.g. PSA, PSCA and PSM expression for prostate cancer etc.) as well as gross cytological observations (see, e.g., Bocking et al., 1984, Anal. Quant. Cytol. 6(2):74-88; Epstein, 1995, Hum. Pathol. 26(2):223-9; Thorson et al., 1998, Mod. Pathol. 11(6):543-51; Baisden et al., 1999, Am. J. Surg. Pathol. 23(8):918-24). Methods for observing a coincidence between the expression of 98P4B6 gene and 98P4B6 gene products (or perturbations in 98P4B6 gene and 98P486 gene products) and another factor that is associated with malignancy are useful, for example, because the presence of a set of specific factors that coincide with disease provides information crucial for diagnosing and prognosticating the status of a issue sample.

In one embodiment, methods for observing a coincidence between the expression of 98P4B6 gene and 98P4B6 gene products (or perturbations in 98P4B6 gene and 98P4B6 gene products) and another factor associated with malignancy entails detecting the overexpression of 98P4B6 mRNA or protein in a tissue sample, detecting the overexpression of PSA mRNA or protein in a issue sample (or PSCA or PSM expression), and observing a coincidence of 98P4B6 mRNA or protein and PSA mRNA or protein overexpression (or PSCA or PSM expression). In a specific embodiment, the expression of 98P4B6 and PSA mRNA in prostate issue is examined, where the coincidence of 98P4B6 and PSA mRNA overexpression in the sample indicates the existence of prostate cancer, prostate cancer susceptibility or the emergence or status of a prostate tumor.

Methods for detecting and quantifying the expression of 98P4B6 mRNA or protein are described herein, and standard nucleic acid and protein detection and quantification technologies are well known in the art. Standard methods for the detection and quantification of 98P4B6 mRNA include in situ hybridization using labeled 98P4B6 riboprobes, Northern blot and related techniques using 98P4B6 polynucleotide probes, RT-PCR analysis using primers specific for 98P4B6, and other amplification type detection methods, such as, for example, branched DNA, SISBA, TMA and the like. In a specific embodiment, semi-quantitative RT-PCR is used to detect and quantify 98P4B6 mRNA expression. Any number of primers capable of amplifying 98P4B6 can be used for this purpose, including but not limited to the various primer sets specifically described herein. In a specific embodiment, polyclonal or monoclonal antibodies specifically reactive with the wild-type 98P4B6 protein can be used in an immunohistochemical assay of biopsied tissue.

IX.) Identification of Molecules That Interact With 98P4B6

The 98P4B6 protein and nucleic acid sequences disclosed herein allow a skilled artisan to identify proteins, small molecules and other agents that interact with 98P4B6, as well as pathways activated by 98P4B6 via any one of a variety of art accepted protocols. For example, one can utilize one of the so-called interaction trap systems (also referred to as the "two-hybrid assay"). In such systems, molecules interact and reconstitute a transcription factor which directs expression of a reporter gene, whereupon the expression of the reporter gene is assayed. Other systems identify protein-protein interactions in vivo through reconstitution of a eukaryotic transcriptional activator, see, e.g., U.S. Pat. No. 5,955,280 issued 21 Sep. 1999, U.S. Pat. No. 5,925,523 issued 20 Jul. 1999, U.S. Pat. No. 5,846,722 issued 8 Dec. 1998 and U.S. Pat. No. 6,004,746 issued 21 Dec. 1999. Algorithms are also available in the art for genome-based predictions of protein function (see, e.g., Marcotte, et al., Nature 402: 4 Nov. 1999, 83-86).

Alternatively one can screen peptide libraries to identify molecules that interact with 98P4B6 protein sequences. In such methods, peptides that bind to 98P4B6 are identified by screening libraries that encode a random or controlled collection of amino acids. Peptides encoded by the libraries are expressed as fusion proteins of bacteriophage coat proteins, the bacteriophage particles are then screened against the 98P4B6 protein(s).

Accordingly, peptides having a wide variety of uses, such as therapeutic, prognostic or diagnostic reagents, are thus identified without any prior information on the structure of the expected ligand or receptor molecule. Typical peptide libraries and screening methods that can be used to identify molecules that interact with 98P4B6 protein sequences are disclosed for example in U.S. Pat. No. 5,723,286 issued 3 Mar. 1998 and U.S. Pat. No. 5,733,731 issued 31 Mar. 1998.

Alternatively, cell lines that express 98P4B6 are used to identify protein-protein interactions mediated by 98P4B6. Such interactions can be examined using immunoprecipitation techniques (see, e.g., Hamilton B.J., et al. Biochem. Biophys. Res. Commun. 1999, 261:646-51). 98P4B6 protein can be immunoprecipitated from 98P4B6-expressing cell lines using anti-98P4B6 antibodies. Alternatively, antibodies against His-tag can be used in a cell line engineered to express fusions of 98P4B6 and a His-tag (vectors mentioned above). The immunoprecipitated complex can be examined for protein association by procedures such as Western blotting, $^{35}$S-methionine labeling of proteins, protein microsequencing, silver staining and two-dimensional gel electrophoresis.

Small molecules and ligands that interact with 98P4B6 can be identified through related embodiments of such screening assays. For example, small molecules can be identified that interfere with protein function, including molecules that interfere with 98P4B6's ability to mediate phosphorylation and de-phosphorylation, interaction with DNA or RNA molecules as an indication of regulation of cell cycles, second messenger signaling or tumorigenesis. Similarly, small molecules that modulate 98P4B6-related ion channel, protein pump, or cell communication functions are identified and used to treat patients that have a cancer that expresses 98P4B6 (see, e.g., Hille, B., Ionic Channels of Excitable Membranes $2^{nd}$ Ed., Sinauer Assoc., Sunderland, Mass., 1992). Moreover, ligands that regulate 98P4B6 function can be identified based on their ability to bind 98P4B6 and activate a reporter construct. Typical methods are discussed for example in U.S. Pat. No. 5,928,868 issued 27 Jul. 1999, and include methods for forming hybrid ligands in which at least one ligand is a small molecule. In an illustrative embodiment, cells engineered to express a fusion protein of 98P4B6 and a DNA-binding protein are used to co-express a fusion protein of a hybrid ligand/small molecule and a cDNA library transcriptional activator protein. The cells further contain a reporter gene, the expression of which is conditioned on the proximity of the first and second fusion proteins to each other, an event that occurs only if the hybrid ligand binds to target sites on both hybrid proteins. Those cells that express the reporter gene are selected and the unknown small molecule or the unknown ligand is identified. This method provides a means of identifying modulators, which activate or inhibit 98P4B6.

An embodiment of this invention comprises a method of screening for a molecule that interacts with a 98P4B6 amino acid sequence shown in FIG. 2 or FIG. 3, comprising the steps of contacting a population of molecules with a 98P4B6 amino acid sequence, allowing the population of molecules and the 98P4B6 amino acid sequence to interact under conditions that facilitate an interaction, determining the presence of a molecule that interacts with the 98P4B6 amino acid sequence, and then separating molecules that do not interact with the 98P4B6 amino acid sequence from molecules that do. In a specific embodiment, the method further comprises purifying, characterizing and identifying a molecule that interacts with the 98P4B6 amino acid sequence. The identified molecule can be used to modulate a function performed by 98P4B6. In a preferred embodiment, the 98P4B6 amino acid sequence is contacted with a library of peptides.

X.) Therapeutic Methods and Compositions

The identification of 98P4B6 as a protein that is normally expressed in a restricted set of tissues, but which is also expressed in prostate and other cancers, opens a number of therapeutic approaches to the treatment of such cancers. As contemplated herein, 98P4B6 functions as a transcription factor involved in activating tumor-promoting genes or repressing genes that block tumorigenesis.

Accordingly, therapeutic approaches that inhibit the activity of a 98P4B6 protein are useful for patients suffering from a cancer that expresses 98P4B6. These therapeutic approaches generally fall into two classes. One class comprises various methods for inhibiting the binding or association of a 98P4B6 protein with its binding partner or with other proteins. Another class comprises a variety of methods for inhibiting the transcription of a 98P4B6 gene or translation of 98P4B6 mRNA.

X.A.) Anti-Cancer Vaccines

The invention provides cancer vaccines comprising a 98P4B6-related protein or 98P4B6-related nucleic acid. In view of the expression of 98P4B6, cancer vaccines prevent and/or treat 98P4B6-expressing cancers with minimal or no effects on non-target tissues. The use of a tumor antigen in a vaccine that generates humoral and/or cell-mediated immune responses as anti-cancer therapy is well known in the art and has been employed in prostate cancer using human PSMA and rodent PAP immunogens (Hodge et al., 1995, Int. J. Cancer 63:231-237; Fong et al., 1997, J. Immunol. 159:3113-3117).

Such methods can be readily practiced by employing a 98P4B6-related protein, or a 98P4B6-encoding nucleic acid molecule and recombinant vectors capable of expressing and presenting the 98P4B6 immunogen (which typically comprises a number of antibody or T cell epitopes). Skilled artisans understand that a wide variety of vaccine systems for delivery of immunoreactive epitopes are known in the art (see, e.g., Heryln et al., Ann Med 1999 Feb 31(1):66-78; Maruyama et al., Cancer Immunol Immunother 2000 June 49(3):123-32) Briefly, such methods of generating an immune response (e.g. humoral and/or cell-mediated) in a mammal, comprise the steps of: exposing the mammal's immune system to an immunoreactive epitope (e.g. an epitope present in a 98P4B6 protein shown in FIG. 3 or analog or homolog thereof) so that the mammal generates an immune response that is specific for that epitope (e.g. generates antibodies that specifically recognize that epitope). In a preferred method, a 98P4B6 immunogen contains a biological motif, see e.g., Tables VIII-XXI and XXII-XLIX, or a peptide of a size range from 98P4B6 indicated in FIG. 5, FIG. 6, FIG. 7, FIG. 8, and FIG. 9.

The entire 98P4B6 protein, immunogenic regions or epitopes thereof can be combined and delivered by various means. Such vaccine compositions can include, for example, lipopeptides (e.g., Vitiello, A. et al., *J. Clin. Invest.* 95:341, 1995), peptide compositions encapsulated in poly(DL-lactide-co-glycolide) ("PLG") microspheres (see, e.g., Eldridge, et al., *Molec. Immunol.* 28:287-294, 1991: Alonso et al., *Vaccine* 12:299-306, 1994; Jones et al., *Vaccine* 13:675-681, 1995), peptide compositions contained in immune stimulating complexes (ISCOMS) (see, e.g., Takahashi et al., *Nature* 344:873-875, 1990; Hu et al., *Clin Exp Immunol.* 113:235-243, 1998), multiple antigen peptide systems (MAPs) (see e.g., Tam, J. P., *Proc. Natl. Acad. Sci. U.S.A.* 85:5409-5413, 1988; Tam, J. P., *J. Immunol. Methods* 196:17-32,1996), peptides formulated as multivalent peptides; peptides for use in ballistic delivery systems, typically crystallized peptides, viral delivery vectors (Perkus, M. E. et al., In: *Concepts in vaccine development*, Kaufmann, S. H. E., ed., p. 379, 1996; Chakrabarti, S. et al., *Nature* 320:535,1986; Hu, S. L. et al., *Nature* 320:537, 1986; Kieny, M.-P. et al., *AIDS Bio/Technology* 4:790, 1986; Top, F. H. et al., *J. Infect. Dis.* 124:148,1971; Chanda, P. K. et al., *Virology* 175:535, 1990), particles of viral or synthetic origin (e.g., Kofler, N. et al., *J. Immunol. Methods.* 192:25, 1996; Eldridge, J. H. et al., *Sem. Hematol.* 30:16, 1993; Falo, L. D., Jr. et al., *Nature Med.* 7:649, 1995), adjuvants (Warren, H. S., Vogel, F. R., and Chedid, L. A. *Annu. Rev. Immunol.* 4:369, 1986; Gupta, R. K. et al., Vaccine 11:293, 1993), liposomes (Reddy, R. et al., *J. Immunol.* 148: 1585,1992; Rock, K. L., *Immunol. Today* 17:131, 1996), or, naked or particle absorbed cDNA (Ulmer, J. B. et al., *Science* 259:1745, 1993; Robinson, H. L., Hunt, L. A., and Webster, R. G., *Vaccine* 11:957, 1993; Shiver, J. W. et al., In: Concepts in vaccine development, Kaufmann, S. H. E., ed., p. 423, 1996; Cease, K. B., and Berzofsky, J. A., *Annu. Rev. Immunol.* 12:923, 1994 and Eldridge, J. H. et al., *Sem. Hematol.* 30:16, 1993). Toxin-targeted delivery technologies, also known as receptor mediated targeting, such as those of Avant Immunotherapeutics, Inc. (Needham, Mass.) may also be used.

In patients with 98P4B6-associated cancer, the vaccine compositions of the invention can also be used in conjunction with other treatments used for cancer, e.g., surgery, chemotherapy, drug therapies, radiation therapies, etc. including use in combination with immune adjuvants such as IL-2, IL-12, GM-CSF, and the like.

Cellular Vaccines:

CTL epitopes can be determined using specific algorithms to identify peptides within 98P4B6 protein that bind corresponding HLA alleles (see e.g., Table IV; Epimer™ and Epimatrix™, Brown University; and, BIMAS. In a preferred embodiment, a 98P4B6 immunogen contains one or more amino acid sequences identified using techniques well known in the art, such as the sequences shown in Tables VIII-XXI and XXII-XLIX or a peptide of 8, 9, 10 or 11 amino acids specified by an HLA Class I motif/supermotif (e.g., Table IV (A), Table IV (D), or Table IV (E)) and/or a peptide of at least 9 amino acids that comprises an HLA Class II motif/supermotif (e.g., Table IV (B) or Table IV (C)). As is appreciated in the art, the HLA Class I binding groove is essentially closed ended so that peptides of only a particular size range can fit into the groove and be bound, generally HLA Class I epitopes are 8, 9, 10, or 11 amino acids long. In contrast, the HLA Class II binding groove is essentially open ended; therefore a peptide of about 9 or more amino acids can be bound by an HLA Class II molecule. Due to the binding groove differences between HLA Class I and II, HLA Class I motifs are length specific, i.e., position two of a Class I motif is the second amino acid in an amino to carboxyl direction of the peptide. The amino acid positions in a Class II motif are relative only to each other, not the overall peptide, i.e., additional amino acids can be attached to the amino and/or carboxyl termini of a motif-bearing sequence. HLA Class II epitopes are often 9, 10, 11, 12, 13, 14, 15, 16, 17, 18, 19, 20, 21, 22, 23, 24, or 25 amino acids long, or longer than 25 amino acids.

Antibody-based Vaccines

A wide variety of methods for generating an immune response in a mammal are known in the art (for example as the first step in the generation of hybridomas). Methods of generating an immune response in a mammal comprise exposing the mammal's immune system to an immunogenic epitope on a protein (e.g. a 98P4B6 protein) so that an immune response is generated. A typical embodiment consists of a method for generating an immune response to 98P4B6 in a host, by contacting the host with a sufficient amount of at least one 98P4B6 B cell or cytotoxic T-cell epitope or analog thereof; and at least one periodic interval thereafter re-contacting the host with the 98P4B6 B cell or cytotoxic T-cell epitope or analog thereof. A specific embodiment consists of a method of generating an immune response against a 98P4B6-related protein or a man-made multiepitopic peptide comprising: administering 98P4B6 immunogen (e.g. a 98P4B6 protein or a peptide fragment thereof, a 98P4B6 fusion protein or analog etc.) in a vaccine preparation to a human or another mammal. Typically, such vaccine preparations further contain a suitable adjuvant (see, e.g., U.S. Pat. No. 6,146,635) or a universal helper epitope such as a PADRE™ peptide (Epimmune Inc., San Diego, Calif.; see, e.g., Alexander et al., J. Immunol. 2000 164(3); 164(3): 1625-1633; Alexander et al., Immunity 1994 1(9): 751-761 and Alexander et al., Immunol. Res. 1998 18(2): 79-92). An alternative method comprises generating an immune response in an individual against a 98P4B6 immunogen by: administering in vivo to muscle or skin of the individual's body a DNA molecule that comprises a DNA sequence that encodes a 98P4B6 immunogen, the DNA sequence operatively linked to regulatory sequences which control the expression of the DNA sequence; wherein the DNA molecule is taken up by cells, the DNA sequence is expressed in the cells and an immune response is generated against the immunogen (see, e.g., U.S. Pat. No. 5,962,428). Optionally a genetic vaccine facilitator such as anionic lipids; saponins; lectins; estrogenic compounds; hydroxylated lower alkyls; dimethyl sulfoxide; and urea is also administered. In addition, an antiidiotypic antibody can be administered that mimics 98P4B6, in order to generate a response to the target antigen.

Nucleic Acid Vaccines:

Vaccine compositions of the invention include nucleic acid-mediated modalities. DNA or RNA that encode protein(s) of the invention can be administered to a patient. Genetic immunization methods can be employed to generate prophylactic or therapeutic humoral and cellular immune responses directed against cancer cells expressing 98P4B6. Constructs comprising DNA encoding a 98P4B6-related protein/immunogen and appropriate regulatory sequences can be injected directly into muscle or skin of an individual, such that the cells of the muscle or skin take-up the construct and express the encoded 98P4B6 protein/immunogen. Alternatively, a vaccine comprises a 98P4B6-related protein. Expression of the 98P4B6-related protein immunogen results in the generation of prophylactic or therapeutic humoral and cellular immunity against cells that bear a 98P4B6 protein. Various prophylactic and therapeutic genetic immunization techniques known in the art can be used (for review, see information and references published at Internet address genweb.com). Nucleic acid-based delivery is described, for instance, in Wolff et. al., Science 247:1465 (1990) as well as U.S. Pat. Nos. 5,580,859; 5,589,466; 5,804,566; 5,739,118; 5,736,524; 5,679,647; WO 98/04720. Examples of DNA-based delivery technologies include "naked DNA", facilitated (bupivicaine, polymers, peptide-mediated) delivery, cationic lipid complexes, and particle-mediated ("gene gun") or pressure-mediated delivery (see, e.g., U.S. Pat. No. 5,922,687).

For therapeutic or prophylactic immunization purposes, proteins of the invention can be expressed via viral or bacterial vectors. Various viral gene delivery systems that can be used in the practice of the invention include, but are not limited to, vaccinia, fowlpox, canarypox, adenovirus, influenza, poliovirus, adeno-associated virus, lentivirus, and sindbis virus (see, e.g., Restifo, 1996, Curr. Opin. Immunol. 8:658-663; Tsang et al. J. Natl. Cancer Inst. 87:982-990 (1995)). Non-viral delivery systems can also be employed by introducing naked DNA encoding a 98P4B6-related protein into the patient (e.g., intramuscularly or intradermally) to induce an anti-tumor response.

Vaccinia virus is used, for example, as a vector to express nucleotide sequences that encode the peptides of the invention. Upon introduction into a host, the recombinant vaccinia virus expresses the protein immunogenic peptide, and thereby elicits a host immune response. Vaccinia vectors and methods useful in immunization protocols are described in, e.g., U.S. Pat. No. 4,722,848. Another vector is BCG (Bacille Calmette Guerin). BCG vectors are described in Stover et al., Nature 351:456460 (1991). A wide variety of other vectors useful for therapeutic administration or immunization of the peptides of the invention, e.g. adeno and adeno-associated virus vectors, retroviral vectors, Salmonella typhi vectors, detoxified anthrax toxin vectors, and the like, will be apparent to those skilled in the art from the description herein.

Thus, gene delivery systems are used to deliver a 98P4B6-related nucleic acid molecule. In one embodiment, the full-length human 98P4B6 cDNA is employed. In another embodiment, 98P4B6 nucleic acid molecules encoding specific cytotoxic T lymphocyte (CTL) and/or antibody epitopes are employed.

Ex Vivo Vaccines

Various ex vivo strategies can also be employed to generate an immune response. One approach involves the use of antigen presenting cells (APCs) such as dendritic cells (DC) to present 98P4B6 antigen to a patient's immune system. Dendritic cells express MHC class I and II molecules, B7 co-stimulator, and IL-12, and are thus highly specialized antigen presenting cells. In prostate cancer, autologous dendritic cells pulsed with peptides of the prostate-specific membrane antigen (PSMA) are being used in a Phase I clinical trial to stimulate prostate cancer patients' immune systems (Tjoa et al., 1996, Prostate 28:65-69; Murphy et al., 1996, Prostate 29:371-380). Thus, dendritic cells can be used to present 98P4B6 peptides to T cells in the context of MHC class I or II molecules. In one embodiment, autologous dendritic cells are pulsed with 98P4B6 peptides capable of binding to MHC class I and/or class II molecules. In another embodiment, dendritic cells are pulsed with the complete 98P4B6 protein. Yet another embodiment involves engineering the overexpression of a 98P4B6 gene in dendritic cells using various implementing vectors known in the art, such as adenovirus (Arthur et al., 1997, Cancer Gene Ther. 4:17-25), retrovirus (Henderson et al., 1996, Cancer Res. 56:3763-3770), lentivirus, adeno-associated virus, DNA transfection (Ribas et al., 1997, Cancer Res. 57:2865-2869), or tumor-derived RNA transfection (Ashley et al., 1997, J. Exp. Med. 186:1177-1182). Cells that express 98P4B6 can also be engineered to express immune modulators, such as GM-CSF, and used as immunizing agents.

X.B.) 98P4B6 as a Target for Antibody-based Therapy

98P4B6 is an attractive target for antibody-based therapeutic strategies. A number of antibody strategies are known in the art for targeting both extracellular and intracellular molecules (see, e.g., complement and ADCC mediated killing as well as the use of intrabodies). Because 98P4B6 is expressed by cancer cells of various lineages relative to corresponding normal cells, systemic administration of 98P4B6-immunoreactve compositions are prepared that exhibit excellent sensitivity without toxic, non-specific and/or non-target effects caused by binding of the immunoreactive composition to non-target organs and tissues. Antibodies specifically reactive with domains of 98P4B6 are useful to treat 98P4B6-expressing cancers systemically, either as conjugates with a toxin or therapeutic agent, or as naked antibodies capable of inhibiting cell proliferation or function.

98P4B6 antibodies can be introduced into a patient such that the antibody binds to 98P4B6 and modulates a function, such as an interaction with a binding partner, and consequently mediates destruction of the tumor cells and/or inhibits the growth of the tumor cells. Mechanisms by which such antibodies exert a therapeutic effect can include complement-mediated cytolysis, antibody-dependent cellular cytotoxicity, modulation of the physiological function of 98P4B6, inhibition of ligand binding or signal transduction pathways, modulation of tumor cell differentiation, alteration of tumor angiogenesis factor profiles, and/or apoptosis.

Those skilled in the art understand that antibodies can be used to specifically target and bind immunogenic molecules such as an immunogenic region of a 98P4B6 sequence shown in FIG. 2 or FIG. 3. In addition, skilled artisans understand that it is routine to conjugate antibodies to cytotoxic agents (see, e.g., Slevers et al. *Blood* 93:11 3678-3684 (Jun. 1, 1999)). When cytotoxic and/or therapeutic agents are delivered directly to cells, such as by conjugating them to antibodies specific for a molecule expressed by that cell (e.g. 98P4B6), the cytotoxic agent will exert its known biological effect (i.e. cytotoxicity) on those cells.

A wide variety of compositions and methods for using antibody-cytotoxic agent conjugates to kill cells are known in the art. In the context of cancers, typical methods entail administering to an animal having a tumor a biologically effective amount of a conjugate comprising a selected cytotoxic and/or therapeutic agent linked to a targeting agent (e.g. an anti-98P4B6 antibody) that binds to a marker (e.g. 98P4B6) expressed, accessible to binding or localized on the cell surfaces. A typical embodiment is a method of delivering a cytotoxic and/or therapeutic agent to a cell expressing 98P4B6, comprising conjugating the cytotoxic agent to an antibody that immunospecifically binds to a 98P4B6 epitope, and, exposing the cell to the antibody-agent conjugate. Another illustrative embodiment is a method of treating an individual suspected of suffering from metastasized cancer, comprising a step of administering parenterally to said individual a pharmaceutical composition comprising a therapeutically effective amount of an antibody conjugated to a cytotoxic and/or therapeutic agent.

Cancer immunotherapy using anti-98P4B6 antibodies can be done in accordance with various approaches that have been successfully employed in the treatment of other types of cancer, including but not limited to colon cancer (Arlen et al., 1998, Crit. Rev. Immunol. 18:133-138), multiple myeloma (Ozaki et al., 1997, Blood 90:3179-3186, Tsunenari et al., 1997, Blood 90:2437-2444), gastric cancer (Kasprzyk et al., 1992, Cancer Res. 52:2771-2776), B-cell lymphoma (Funakoshi et al., 1996, J. Immunother. Emphasis Tumor Immunol. 19:93-101), leukemia (Zhong et al., 1996, Leuk. Res. 20:581-589), colorectal cancer (Moun et al., 1994, Cancer Res. 54:6160-6166; Velders et al., 1995, Cancer Res. 55:4398-4403), and breast cancer (Shepard et al., 1991, J. Clin. Immunol. 11:117-127). Some therapeutic approaches involve conjugation of naked antibody to a toxin or radioisotope, such as the conjugation of $Y^{91}$ or I131 to anti-CD20 antibodies (e.g., Zevalin™, IDEC Pharmaceuticals Corp. or Bexxar™, Coulter Pharmaceuticals), while others involve co-administration of antibodies and other therapeutic agents, such as Herceptin™ (trastuzumab) with paclitaxel (Genentech, Inc.). The antibodies can be conjugated to a therapeutic agent. To treat prostate cancer, for example, 98P4B6 antibodies can be administered in conjunction with radiation, chemotherapy or hormone ablation. Also, antibodies can be conjugated to a toxin such as calicheamicin (e.g., Mylotarg™, Wyeth-Ayerst, Madison, N.J., a recombinant humanized $IgG_4$ kappa antibody conjugated to antitumor antibiotic calicheamicin) or a maytansinoid (e.g., taxane-based Tumor-Activated Prodrug, TAP, platform, ImmunoGen, Cambridge, Mass., also see e.g., U.S. Pat. No. 5,416,064).

Although 98P4B6 antibody therapy is useful for all stages of cancer, antibody therapy can be particularly appropriate in advanced or metastatic cancers. Treatment with the antibody therapy of the invention is indicated for patients who have received one or more rounds of chemotherapy. Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very well. Fan et al. (Cancer Res. 53:46374642, 1993), Prewett et al. (International J. of Onco. 9:217-224, 1996), and Hancock et al. (Cancer Res. 51:4575-4580, 1991) describe the use of various antibodies together with chemotherapeutic agents.

Although 98P4B6 antibody therapy is useful for all stages of cancer, antibody therapy can be particularly appropriate in advanced or metastatic cancers. Treatment with the antibody therapy of the invention is indicated for patients who have received one or more rounds of chemotherapy. Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very well.

Cancer patients can be evaluated for the presence and level of 98P4B6 expression, preferably using immunohistochemical assessments of tumor tissue, quantitative 98P4B6 imaging, or other techniques that reliably indicate the presence and degree of 98P4B6 expression. Immunohistochemical analysis of tumor biopsies or surgical specimens is preferred for this purpose. Methods for immunohistochemical analysis of tumor tissues are well known in the art.

Anti-98P4B6 monoclonal antibodies that treat prostate and other cancers include those that initiate a potent immune response against the tumor or those that are directly cytotoxic. In this regard, anti-98P4B6 monoclonal antibodies (mAbs) can elicit tumor cell lysis by either complement-mediated or antibody-dependent cell cytotoxicity (ADCC) mechanisms, both of which require an intact Fc portion of the immunoglobulin molecule for interaction with effector cell Fc receptor sites on complement proteins. In addition, anti-98P4B6 mAbs that exert a direct biological effect on tumor growth are useful to treat cancers that express 98P4B6. Mechanisms by which directly cytotoxic mAbs act include: inhibition of cell growth, modulation of cellular differentiation, modulation of tumor angiogenesis factor profiles, and the induction of apoptosis. The mechanism(s) by which a particular anti-98P4B6 mAb exerts an anti-tumor effect is evaluated using any number of in vitro assays that evaluate cell death such as ADCC, ADMMC, complement-mediated cell lysis, and so forth, as is generally known in the art.

In some patients, the use of murine or other non-human monoclonal antibodies, or human/mouse chimeric mAbs can induce moderate to strong immune responses against the non-human antibody. This can result in clearance of the antibody from circulation and reduced efficacy. In the most severe cases, such an immune response can lead to the extensive formation of immune complexes which, potentially, can cause renal failure. Accordingly, preferred monoclonal antibodies used in the therapeutic methods of the invention are those that are either fully human or humanized and that bind specifically to the target 98P4B6 antigen with high affinity but exhibit low or no antigenicity in the patient.

Therapeutic methods of the invention contemplate the administration of single anti-98P4B6 mAbs as well as combinations, or cocktails, of different mAbs. Such mAb cocktails can have certain advantages inasmuch as they contain mAbs that target different epitopes, exploit different effector mechanisms or combine directly cytotoxic mAbs with mAbs that rely on immune effector functionality. Such mAbs in combination can exhibit synergistic therapeutic effects. In addition, anti-98P4B6 mAbs can be administered concomitantly with other therapeutic modalities, including but not limited to various chemotherapeutic agents, androgen-blockers, immune modulators (e.g., IL-2, GM-CSF), surgery or radiation. The anti-98P4B6 mAbs are administered in their "naked" or unconjugated form, or can have a therapeutic agent(s) conjugated to them.

Anti-98P4B6 antibody formulations are administered via any route capable of delivering the antibodies to a tumor cell. Routes of administration include, but are not limited to, intravenous, intraperitoneal, intramuscular, intratumor, intradermal, and the like. Treatment generally involves repeated administration of the anti-98P4B6 antibody preparation, via an acceptable route of administration such as intravenous injection (IV), typically at a dose in the range of about 0.1, 0.2, 0.3, 0.4, 0.5, 0.6, 0.7, 0.8, 0.9, 1, 2, 3, 4, 5, 6, 7, 8, 9, 10, 15, 20, or 25 mg/kg body weight. In general, doses in the range of 10-1000 mg mAb per week are effective and well tolerated.

Based on clinical experience with the Herceptin™ mAb in the treatment of metastatic breast cancer, an initial loading dose of approximately 4 mg/kg patient body weight IV, followed by weekly doses of about 2 mg/kg IV of the anti-98P4B6 mAb preparation represents an acceptable dosing regimen. Preferably, the initial loading dose is administered as a 90-minute or longer infusion. The periodic maintenance dose is administered as a 30 minute or longer infusion, provided the initial dose was well tolerated. As appreciated by those of skill in the art, various factors can influence the ideal dose regimen in a particular case. Such factors include, for example, the binding affinity and half life of the Ab or mAbs used, the degree of 98P4B6 expression in the patient, the extent of circulating shed 98P4B6 antigen, the desired steady-state antibody concentration level, frequency of treatment, and the influence of chemotherapeutic or other agents used in combination with the treatment method of the invention, as well as the health status of a particular patient.

Optionally, patients should be evaluated for the levels of 98P4B6 in a given sample (e.g. the levels of circulating 98P4B6 antigen and/or 98P4B6 expressing cells) in order to assist in the determination of the most effective dosing regimen, etc. Such evaluations are also used for monitoring purposes throughout therapy, and are useful to gauge therapeutic success in combination with the evaluation of other parameters (for example, urine cytology and/or ImmunoCyt levels in bladder cancer therapy, or by analogy, serum PSA levels in prostate cancer therapy).

Anti-idiotypic anti-98P4B6 antibodies can also be used in anti-cancer therapy as a vaccine for inducing an immune response to cells expressing a 98P4B6-related protein. In particular, the generation of anti-idiotypic antibodies is well known in the art; this methodology can readily be adapted to generate anti-idiotypic anti-98P4B6 antibodies that mimic an epitope on a 98P4B6-related protein (see, for example, Wagner et al., 1997, Hybridoma 16: 33-40; Foon et al., 1995, J. Clin. Invest. 96:334-342; Herlyn et al., 1996, Cancer Immunol. Immunother. 43:65-76). Such an anti-idiotypic antibody can be used in cancer vaccine strategies.

X.C.) 98P4B6 as a Target for Cellular Immune Responses

Vaccines and methods of preparing vaccines that contain an immunogenically effective amount of one or more HLA-binding peptides as described herein are further embodiments of the invention. Furthermore, vaccines in accordance with the invention encompass compositions of one or more of the claimed peptides. A peptide can be present in a vaccine individually. Alternatively, the peptide can exist as a homopolymer comprising multiple copies of the same peptide, or as a heteropolymer of various peptides. Polymers have the advantage of increased immunological reaction and, where different peptide epitopes are used to make up the polymer, the additional ability to induce antibodies and/or CTLs that react with different antigenic determinants of the pathogenic organism or tumor-related peptide targeted for an immune response. The composition can be a naturally occurring region of an antigen or can be prepared, e.g., recombinantly or by chemical synthesis.

Carriers that can be used with vaccines of the invention are well known in the art, and include, e.g., thyroglobulin, albumins such as human serum albumin, tetanus toxoid, polyamino acids such as poly L-lysine, poly L-glutamic acid, influenza, hepatitis B virus core protein, and the like. The vaccines can contain a physiologically tolerable (i.e., acceptable) diluent such as water, or saline, preferably phosphate buffered saline. The vaccines also typically include an adjuvant. Adjuvants such as incomplete Freund's adjuvant, aluminum phosphate, aluminum hydroxide, or alum are examples of materials well known in the art. Additionally, as disclosed herein, CTL responses can be primed by conjugating peptides of the invention to lipids, such as tripalmitoyl-S-glycerylcysteinlyseryl-serine ($P_3CSS$). Moreover, an adjuvant such as a synthetic cytosine-phosphorothiolated-guanine-containing (CpG) oligonucleotides has been found to increase CTL responses 10- to 100-fold. (see, e.g. Davila and Celis, J. Immunol. 165:539-547 (2000))

Upon immunization with a peptide composition in accordance with the invention, via injection, aerosol, oral, transdermal, transmucosal, intrapleural, intrathecal, or other suitable routes, the immune system of the host responds to the vaccine by producing large amounts of CTLs and/or HTLs specific for the desired antigen. Consequently, the host becomes at least partially immune to later development of cells that express or overexpress 98P4B6 antigen, or derives at least some therapeutic benefit when the antigen was tumor-associated.

In some embodiments, it may be desirable to combine the class I peptide components with components that induce or facilitate neutralizing antibody and or helper T cell responses directed to the target antigen. A preferred embodiment of such a composition comprises class I and class II epitopes in accordance with the invention. An alternative embodiment of such a composition comprises a class I and/or class II epitope in accordance with the invention, along with a cross reactive HTL epitope such as PADRE™ (Epimmune, San Diego, Calif.) molecule (described e.g., in U.S. Pat. No. 5,736,142).

A vaccine of the invention can also include antigen-presenting cells (APC), such as dendritic cells (DC), as a vehicle to present peptides of the invention. Vaccine compositions can be created in vitro, following dendritic cell mobilization and harvesting, whereby loading of dendritic cells occurs in vitro. For example, dendritic cells are transfected, e.g., with a minigene in accordance with the invention, or are pulsed with peptides. The dendritic cell can then be administered to a patient to elicit immune responses in vivo. Vaccine compositions, either DNA- or peptide-based, can also be administered in vivo in combination with dendritic cell mobilization whereby loading of dendritic cells occurs in vivo.

Preferably, the following principles are utilized when selecting an array of epitopes for inclusion in a polyepitopic composition for use in a vaccine, or for selecting discrete epitopes to be included in a vaccine and/or to be encoded by nucleic acids such as a minigene. It is preferred that each of the following principles be balanced in order to make the selection. The multiple epitopes to be incorporated in a given vaccine composition may be, but need not be, contiguous in sequence in the native antigen from which the epitopes are derived.

1.) Epitopes are selected which, upon administration, mimic immune responses that have been observed to be correlated with tumor clearance. For HLA Class I this includes 3-4 epitopes that come from at least one tumor associated antigen (TAA). For HLA Class II a similar rationale is employed; again 3-4 epitopes are selected from at least one TAA (see, e.g., Rosenberg et al., *Science* 278:1447-1450). Epitopes from one TAA may be used in combination with epitopes from one or more additional TAAs to produce a vaccine that targets tumors with varying expression patterns of frequently-expressed TAAs.

2.) Epitopes are selected that have the requisite binding affinity established to be correlated with immunogenicity: for HLA Class I an $IC_{50}$ of 500 nM or less, often 200 nM or less; and for Class II an $IC_{50}$ of 1000 nM or less.

3.) Sufficient supermotif bearing-peptides, or a sufficient array of allele-specific motif-bearing peptides, are selected to give broad population coverage. For example, it is preferable to have at least 80% population coverage. A Monte Carlo analysis, a statistical evaluation known in the art, can be employed to assess the breadth, or redundancy of, population coverage.

4.) When selecting epitopes from cancer-related antigens it is often useful to select analogs because the patient may have developed tolerance to the native epitope.

5.) Of particular relevance are epitopes referred to as "nested epitopes." Nested epitopes occur where at least two epitopes overlap in a given peptide sequence. A nested peptide sequence can comprise B cell, HLA class I and/or HLA class II epitopes. When providing nested epitopes, a general objective is to provide the greatest number of epitopes per sequence. Thus, an aspect is to avoid providing a peptide that is any longer than the amino terminus of the amino terminal epitope and the carboxyl terminus of the carboxyl terminal epitope in the peptide. When providing a multi-epitopic sequence, such as a sequence comprising nested epitopes, it is generally important to screen the sequence in order to insure that it does not have pathological or other deleterious biological properties.

6.) If a polyepitopic protein is created, or when creating a minigene, an objective is to generate the smallest peptide that encompasses the epitopes of interest. This principle is similar, if not the same as that employed when selecting a peptide comprising nested epitopes. However, with an artificial polyepitopic peptide, the size minimization objective is balanced against the need to integrate any spacer sequences between epitopes in the polyepitopic protein. Spacer amino acid residues can, for example, be introduced to avoid junctional epitopes (an epitope recognized by the immune system, not present in the target antigen, and only created by the man-made juxtaposition of epitopes), or to facilitate cleavage between epitopes and thereby enhance epitope presentation. Junctional epitopes are generally to be avoided because the recipient may generate an immune response to that non-native epitope. Of particular concern is a junctional epitope that is a "dominant epitope." A dominant epitope may lead to such a zealous response that immune responses to other epitopes are diminished or suppressed.

7.) Where the sequences of multiple variants of the same target protein are present, potential peptide epitopes can also be selected on the basis of their conservancy. For example, a criterion for conservancy may define that the entire sequence of an HLA class I binding peptide or the entire 9-mer core of a class II binding peptide be conserved in a designated percentage of the sequences evaluated for a specific protein antigen.

X.C.1. Minigene Vaccines

A number of different approaches are available which allow simultaneous delivery of multiple epitopes. Nucleic acids encoding the peptides of the invention are a particularly useful embodiment of the invention. Epitopes for inclusion in a minigene are preferably selected according to the guidelines set forth in the previous section. A preferred means of administering nucleic acids encoding the peptides of the invention uses minigene constructs encoding a peptide comprising one or multiple epitopes of the invention.

The use of multi-epitope minigenes is described below and in, Ishioka et al., *J. Immunol.* 162:3915-3925, 1999; An, L. and Whitton, J. L., *J. Virol.* 71:2292, 1997; Thomson, S. A. et al., *J. Immunol.* 157:822, 1996; Whitton, J. L. et al., *J. Virol.* 67:348, 1993; Hanke, R. et al., *Vaccine* 16:426, 1998. For example, a multi-epitope DNA plasmid encoding supermotif- and/or motif-bearing epitopes derived 98P4B6, the PADRE® universal helper T cell epitope or multiple HTL epitopes from 98P4B6 (see e.g., Tables VIII-XXI and XXII to XLIX), and an endoplasmic reticulum-translocating signal sequence can be engineered. A vaccine may also comprise epitopes that are derived from other TAAs.

The immunogenicity of a multi-epitopic minigene can be confirmed in transgenic mice to evaluate the magnitude of CTL induction responses against the epitopes tested. Further, the immunogenicity of DNA-encoded epitopes in vivo can be correlated with the in vitro responses of specific CTL lines against target cells transfected with the DNA plasmid. Thus, these experiments can show that the minigene serves to both: 1.) generate a CTL response and 2.) that the induced CTLs recognized cells expressing the encoded epitopes.

For example, to create a DNA sequence encoding the selected epitopes (minigene) for expression in human cells, the amino acid sequences of the epitopes may be reverse translated. A human codon usage table can be used to guide the codon choice for each amino acid. These epitope-encoding DNA sequences may be directly adjoined, so that when translated, a continuous polypeptide sequence is created. To optimize expression and/or immunogenicity, additional elements can be incorporated into the minigene design. Examples of amino acid sequences that can be reverse translated and included in the minigene sequence include: HLA class I epitopes, HLA class II epitopes, antibody epitopes, a ubiquitination signal sequence, and/or an endoplasmic reticulum targeting signal. In addition, HLA presentation of CTL and HTL epitopes may be improved by including synthetic (e.g. poly-alanine) or naturally-occurring flanking sequences adjacent to the CTL or HTL epitopes; these larger peptides comprising the epitope(s) are within the scope of the invention.

The minigene sequence may be converted to DNA by assembling oligonucleotides that encode the plus and minus strands of the minigene. Overlapping oligonucleotides (30-100 bases long) may be synthesized, phosphorylated, purified and annealed under appropriate conditions using well known techniques. The ends of the oligonucleotides can be joined, for example, using T4 DNA ligase. This synthetic minigene, encoding the epitope polypeptide, can then be cloned into a desired expression vector.

Standard regulatory sequences well known to those of skill in the art are preferably included in the vector to ensure expression in the target cells. Several vector elements are desirable: a promoter with a down-stream cloning site for minigene insertion; a polyadenylation signal for efficient transcription termination; an E. coli origin of replication; and an E. coli selectable marker (e.g. ampicillin or kanamycin resistance). Numerous promoters can be used for this purpose, e.g., the human cytomegalovirus (hCMV) promoter. See, e.g., U.S. Pat. Nos. 5,580,859 and 5,589,466 for other suitable promoter sequences.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences and sequences for replication in mammalian cells may also be considered for increasing minigene expression.

Once an expression vector is selected, the minigene is cloned into the polylinker region downstream of the promoter. This plasmid is transformed into an appropriate E. coli strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

In addition, immunostimulatory sequences (ISSs or CpGs) appear to play a role in the immunogenicity of DNA vaccines. These sequences may be included in the vector, outside the minigene coding sequence, if desired to enhance immunogenicity.

In some embodiments, a bi-cistronic expression vector which allows production of both the minigene-encoded epitopes and a second protein (included to enhance or decrease immunogenicity) can be used. Examples of proteins or polypeptides that could beneficially enhance the immune response if co-expressed include cytokines (e.g., IL-2, IL-12, GM-CSF), cytokine-inducing molecules (e.g., LeIF), costimulatory molecules, or for HTL responses, pan-DR binding proteins (PADRE™, Epimmune, San Diego, Calif.). Helper (HTL) epitopes can be joined to intracellular targeting signals and expressed separately from expressed CTL epitopes; this allows direction of the HTL epitopes to a cell compartment different than that of the CTL epitopes. If required, this could facilitate more efficient entry of HTL epitopes into the HLA class II pathway, thereby improving HTL induction. In contrast to HTL or CTL induction, specifically decreasing the immune response by co-expression of immunosuppressive molecules (e.g. TGF-β) may be beneficial in certain diseases.

Therapeutic quantities of plasmid DNA can be produced for example, by fermentation in E. coli, followed by purification. Aliquots from the working cell bank are used to inoculate growth medium, and grown to saturation in shaker flasks or a bioreactor according to well-known techniques. Plasmid DNA can be purified using standard bioseparation technologies such as solid phase anion-exchange resins supplied by QIAGEN, Inc. (Valencia, Calif.). If required, supercoiled DNA can be isolated from the open circular and linear forms using gel electrophoresis or other methods.

Purified plasmid DNA can be prepared for injection using a variety of formulations. The simplest of these is reconstitution of lyophilized DNA in sterile phosphate-buffer saline (PBS). This approach, known as "naked DNA," is currently being used for intramuscular (IM) administration in clinical trials. To maximize the immunotherapeutic effects of minigene DNA vaccines, an alternative method for formulating purified plasmid DNA may be desirable. A variety of methods have been described, and new techniques may become available. Cationic lipids, glycolipids, and fusogenic liposomes can also be used in the formulation (see, e.g., as described by WO 93/24640; Mannino & Gould-Fogerite, *BioTechniques* 6(7): 682 (1988); U.S. Pat No. 5,279,833; WO 91/06309; and Felgner, et al., *Proc. Nat'l Acad. Sci. USA* 84:7413 (1987). In addition, peptides and compounds referred to collectively as protective, interactive, non-condensing compounds (PINC) could also be complexed to purified plasmid DNA to influence variables such as stability, intramuscular dispersion, or trafficking to specific organs or cell types.

Target cell sensitization can be used as a functional assay for expression and HLA class I presentation of minigene-encoded CTL epitopes. For example, the plasmid DNA is introduced into a mammalian cell line that is suitable as a target for standard CTL chromium release assays. The transfection method used will be dependent on the final formulation. Electroporation can be used for "naked" DNA, whereas cationic lipids allow direct in vitro transfection. A plasmid expressing green fluorescent protein (GFP) can be co-transfected to allow enrichment of transfected cells using fluorescence activated cell sorting (FACS). These cells are then chromium-51 ($^{51}$Cr) labeled and used as target cells for epitope-specific CTL lines; cytolysis, detected by $^{51}$Cr release, indicates both production of, and HLA presentation of, minigene-encoded CTL epitopes. Expression of HTL epitopes may be evaluated in an analogous manner using assays to assess HTL activity.

In vivo immunogenicity is a second approach for functional testing of minigene DNA formulations. Transgenic mice expressing appropriate human HLA proteins are immunized with the DNA product. The dose and route of administration are formulation dependent (e.g., IM for DNA in PBS, intraperitoneal (i.p.) for lipid-complexed DNA). Twenty-one days after immunization, splenocytes are harvested and restimulated for one week in the presence of peptides encoding each epitope being tested. Thereafter, for CTL effector cells, assays are conducted for cytolysis of peptide-loaded, $^{51}$Cr-labeled target cells using standard techniques. Lysis of target cells that were sensitized by HLA loaded with peptide epitopes, corresponding to minigene-encoded epitopes, demonstrates DNA vaccine function for in vivo induction of CTLs. Immunogenicity of HTL epitopes is confirmed in transgenic mice in an analogous manner.

Alternatively, the nucleic acids can be administered using ballistic delivery as described, for instance, in U.S. Pat. No. 5,204,253. Using this technique, particles comprised solely of DNA are administered. In a further alternative embodiment, DNA can be adhered to particles, such as gold particles.

Minigenes can also be delivered using other bacterial or viral delivery systems well known in the art, e.g., an expression construct encoding epitopes of the invention can be incorporated into a viral vector such as vaccinia.

X.C.2. Combinations of CTL Peptides with Helper Peptides

Vaccine compositions comprising CTL peptides of the invention can be modified, e.g., analoged, to provide desired attributes, such as improved serum half life, broadened population coverage or enhanced immunogenicity.

For instance, the ability of a peptide to induce CTL activity can be enhanced by linking the peptide to a sequence which contains at least one epitope that is capable of inducing a T helper cell response. Although a CTL peptide can be directly linked to a T helper peptide, often CTL epitope/HTL epitope conjugates are linked by a spacer molecule. The spacer is typically comprised of relatively small, neutral molecules, such as amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optionally present spacer need not be comprised of the same residues and thus may be a hetero- or homo-oligomer. When present, the spacer will usually be at least one or two residues, more usually three to six residues and sometimes 10 or more residues. The CTL peptide epitope can be linked to the T helper peptide epitope either directly or via a spacer either at the amino or carboxy terminus of the CTL peptide. The amino terminus of either the immunogenic peptide or the T helper peptide may be acylated.

In certain embodiments, the T helper peptide is one that is recognized by T helper cells present in a majority of a genetically diverse population. This can be accomplished by selecting peptides that bind to many, most, or all of the HLA class II molecules. Examples of such amino acid bind many HLA Class II molecules include sequences from antigens such as tetanus toxoid at positions 830-843 (QYIKANSKFIGITE; SEQ ID NO: 97), *Plasmodium falciparum circumsporozoite* (CS) protein at positions 378-398 (DIEKKIAKMEKASS-VFNWNS; SEQ ID NO: 98), and *Streptococcus* 18 kD protein at positions 116-131 (GAVDSILGGVATYGAA; SEQ ID NO: 99). Other examples include peptides bearing a DR 1-4-7 supermotif, or either of the DR3 motifs.

Alternatively, it is possible to prepare synthetic peptides capable of stimulating T helper lymphocytes, in a loosely HLA-restricted fashion, using amino acid sequences not found in nature (see, e.g., PCT publication WO 95/07707). These synthetic compounds called Pan-DR-binding epitopes (e.g., PADRE™, Epimmune, Inc., San Diego, Calif.) are designed, most preferably, to bind most HLA-DR (human HLA class II) molecules. For instance, a pan-DR-binding epitope peptide having the formula: XKXVAAWTLKAAX (SEQ ID NO: 100), where "X" is either cyclohexylalanine, phenylalanine, or tyrosine, and a is either D-alanine or L-alanine, has been found to bind to most HLA-DR alleles, and to stimulate the response of T helper lymphocytes from most individuals, regardless of their HLA type. An alternative of a pan-DR binding epitope comprises all "L" natural amino acids and can be provided in the form of nucleic acids that encode the epitope.

HTL peptide epitopes can also be modified to alter their biological properties. For example, they can be modified to include D-amino acids to increase their resistance to proteases and thus extend their serum half life, or they can be conjugated to other molecules such as lipids, proteins, carbohydrates, and the like to increase their biological activity. For example, a T helper peptide can be conjugated to one or more palmitic acid chains at either the amino or carboxyl termini.

X.C.3. Combinations of CTL Peptides with T Cell Priming Agents

In some embodiments it may be desirable to include in the pharmaceutical compositions of the invention at least one component which primes B lymphocytes or T lymphocytes. Lipids have been identified as agents capable of priming CTL in vivo. For example, palmitic acid residues can be attached to the $\epsilon$-and $\alpha$-amino groups of a lysine residue and then linked, e.g., via one or more linking residues such as Gly, Gly-Gly-, Ser, Ser-Ser, or the like, to an immunogenic peptide. The lipidated peptide can then be administered either directly in a micelle or particle, incorporated into a liposome, or emulsified in an adjuvant, e.g., incomplete Freund's adjuvant. In a preferred embodiment, a particularly effective immunogenic composition comprises palmitic acid attached to $\epsilon$- and $\alpha$-amino groups of Lys, which is attached via linkage, e.g., Ser-Ser, to the amino terminus of the immunogenic peptide.

As another example of lipid priming of CTL responses, *E. coli* lipoproteins, such as tripalmitoyl-S-glycerylcysteinly-seryl- serine ($P_3CSS$) can be used to prime virus specific CTL when covalently attached to an appropriate peptide (see, e.g., Deres, et al., *Nature* 342:561, 1989). Peptides of the invention can be coupled to $P_3CSS$, for example, and the lipopeptide administered to an individual to prime specifically an immune response to the target antigen. Moreover, because the induction of neutralizing antibodies can also be primed with $P_3CSS$-conjugated epitopes, two such compositions can be combined to more effectively elicit both humoral and cell-mediated responses.

X.C.4. Vaccine Compositions Comprising DC Pulsed with CTL and/or HTL Peptides

An embodiment of a vaccine composition in accordance with the invention comprises ex vivo administration of a cocktail of epitope-bearing peptides to PBMC, or isolated DC therefrom, from the patient's blood. A pharmaceutical to facilitate harvesting of DC can be used, such as Progenipoietin™ (Pharmacia-Monsanto, St. Louis, Mo.) or GM-CSF/IL-4. After pulsing the DC with peptides and prior to reinfusion into patients, the DC are washed to remove unbound peptides. In this embodiment, a vaccine comprises peptide-pulsed DCs which present the pulsed peptide epitopes complexed with HLA molecules on their surfaces.

The DC can be pulsed ex vivo with a cocktail of peptides, some of which stimulate CTL responses to 98P4B6. Optionally, a helper T cell (HTL) peptide, such as a natural or artificial loosely restricted HLA Class II peptide, can be included to facilitate the CTL response. Thus, a vaccine in accordance with the invention is used to treat a cancer which expresses or overexpresses 98P4B6.

X.D. Adoptive Immunotherapy

Antigenic 98P4B6-related peptides are used to elicit a CTL and/or HTL response ex vivo, as well. The resulting CTL or HTL cells, can be used to treat tumors in patients that do not respond to other conventional forms of therapy, or will not respond to a therapeutic vaccine peptide or nucleic acid in accordance with the invention. Ex vivo CTL or HTL responses to a particular antigen are induced by incubating in tissue culture the patient's, or genetically compatible, CTL or HTL precursor cells together with a source of antigen-presenting cells (APC), such as dendritic cells, and the appropriate immunogenic peptide. After an appropriate incubation time (typically about 7-28 days), in which the precursor cells are activated and expanded into effector cells, the cells are infused back into the patient, where they will destroy (CTL) or facilitate destruction (HTL) of their specific target cell (e.g., a tumor cell). Transfected dendritic cells may also be used as antigen presenting cells.

X.E. Administration of Vaccines for Therapeutic or Prophylactic Purposes

Pharmaceutical and vaccine compositions of the invention are typically used to treat and/or prevent a cancer that expresses or overexpresses 98P4B6. In therapeutic applications, peptide and/or nucleic acid compositions are administered to a patient in an amount sufficient to elicit an effective B cell, CTL and/or HTL response to the antigen and to cure or at least partially arrest or slow symptoms and/or complications. An amount adequate to accomplish this is defined as "therapeutically effective dose." Amounts effective for this use will depend on, e.g., the particular composition administered, the manner of administration, the stage and severity of the disease being treated, the weight and general state of health of the patient, and the judgment of the prescribing physician.

For pharmaceutical compositions, the immunogenic peptides of the invention, or DNA encoding them, are generally administered to an individual already bearing a tumor that expresses 98P4B6. The peptides or DNA encoding them can be administered individually or as fusions of one or more peptide sequences. Patients can be treated with the immunogenic peptides separately or in conjunction with other treatments, such as surgery, as appropriate.

For therapeutic use, administration should generally begin at the first diagnosis of 98P4B6-associated cancer. This is followed by boosting doses until at least symptoms are substantially abated and for a period thereafter. The embodiment of the vaccine composition (i.e., including, but not limited to embodiments such as peptide cocktails, polyepitopic polypeptides, minigenes, or TAA-specific CTLs or pulsed dendritic cells) delivered to the patient may vary according to the stage of the disease or the patient's health status. For example, in a patient with a tumor that expresses 98P4B6, a vaccine comprising 98P4B6-specific CTL may be more efficacious in killing tumor cells in patient with advanced disease than alternative embodiments.

It is generally important to provide an amount of the peptide epitope delivered by a mode of administration sufficient to stimulate effectively a cytotoxic T cell response; compositions which stimulate helper T cell responses can also be given in accordance with this embodiment of the invention.

The dosage for an initial therapeutic immunization generally occurs in a unit dosage range where the lower value is about 1, 5, 50, 500, or 1,000 µg and the higher value is about 10,000; 20,000; 30,000; or 50,000 µg. Dosage values for a human typically range from about 500 µg to about 50,000 µg per 70 kilogram patient. Boosting dosages of between about 1.0 µg to about 50,000 µg of peptide pursuant to a boosting regimen over weeks to months may be administered depending upon the patient's response and condition as determined by measuring the specific activity of CTL and HTL obtained from the patent's blood. Administration should continue until at least clinical symptoms or laboratory tests indicate that the neoplasia, has been eliminated or reduced and for a period thereafter. The dosages, routes of administration, and dose schedules are adjusted in accordance with methodologies known in the art.

In certain embodiments, the peptides and compositions of the present invention are employed in serious disease states, that is, life-threatening or potentially life threatening situations. In such cases, as a result of the minimal amounts of extraneous substances and the relative nontoxic nature of the peptides in preferred compositions of the invention, it is possible and may be felt desirable by the treating physician to administer substantial excesses of these peptide compositions relative to these stated dosage amounts.

The vaccine compositions of the invention can also be used purely as prophylactic agents. Generally the dosage for an initial prophylactic immunization generally occurs in a unit dosage range where the lower value is about 1, 5, 50, 500, or 1000 µg and the higher value is about 10,000; 20,000; 30,000; or 50,000 µg. Dosage values for a human typically range from about 500 µg to about 50,000 µg per 70 kilogram patient. This is followed by boosting dosages of between about 1.0 µg to about 50,000 µg of peptide administered at defined intervals from about four weeks to six months after the initial administration of vaccine. The immunogenicity of the vaccine can be assessed by measuring the specific activity of CTL and HTL obtained from a sample of the patient's blood.

The pharmaceutical compositions for therapeutic treatment are intended for parenteral, topical, oral, nasal, intrathecal, or local (e.g. as a cream or topical ointment) administration. Preferably, the pharmaceutical compositions are administered parentally, e.g., intravenously, subcutaneously, intradermally, or intramuscularly. Thus, the invention provides compositions for parenteral administration which comprise a solution of the immunogenic peptides dissolved or suspended in an acceptable carrier, preferably an aqueous carrier.

A variety of aqueous carriers may be used, e.g., water, buffered water, 0.8% saline, 0.3% glycine, hyaluronic acid and the like. These compositions may be sterilized by conventional, well-known sterilization techniques, or may be sterile filtered. The resulting aqueous solutions may be packaged for use as is, or lyophilized, the lyophilized preparation being combined with a sterile solution prior to administration.

The compositions may contain pharmaceutically acceptable auxiliary substances as required to approximate physiological conditions, such as pH-adjusting and buffering agents, tonicity adjusting agents, wetting agents, preservatives, and the like, for example, sodium acetate, sodium lactate, sodium chloride, potassium chloride, calcium chloride, sorbitan monolaurate, triethanolamine oleate, etc.

The concentration of peptides of the invention in the pharmaceutical formulations can vary widely, i.e., from less than about 0.1%, usually at or at least about 2% to as much as 20% to 50% or more by weight, and will be selected primarily by fluid volumes, viscosities, etc., in accordance with the particular mode of administration selected.

A human unit dose form of a composition is typically included in a pharmaceutical composition that comprises a human unit dose of an acceptable carrier, in one embodiment an aqueous carrier, and is administered in a volume/quantity that is known by those of skill in the art to be used for administration of such compositions to humans (see, e.g., Remington's Pharmaceutical Sciences, $17^{th}$ Edition, A. Gennaro, Editor, Mack Publishing Co., Easton, Pa., 1985). For example a peptide dose for initial immunization can be from about 1 to about 50,000 µg, generally 100-5,000 µg, for a 70 kg patient. For example, for nucleic acids an initial immunization may be performed using an expression vector in the form of naked nucleic acid administered IM (or SC or ID) in the amounts of 0.5-5 mg at multiple sites. The nucleic acid (0.1 to 1000 µg) can also be administered using a gene gun. Following an incubation period of 34 weeks, a booster dose is then administered. The booster can be recombinant fowlpox virus administered at a dose of $5\text{-}10^7$ to $5 \times 10^9$ pfu.

For antibodies, a treatment generally involves repeated administration of the anti-98P4B6 antibody preparation, via an acceptable route of administration such as intravenous injection (IV), typically at a dose in the range of about 0.1 to about 10 mg/kg body weight. In general, doses in the range of 10-500 mg mAb per week are effective and well tolerated. Moreover, an initial loading dose of approximately 4 mg/kg patient body weight IV, followed by weekly doses of about 2 mg/kg IV of the anti-98P4B6 mAb preparation represents an acceptable dosing regimen. As appreciated by those of skill in the art, various factors can influence the ideal dose in a particular case. Such factors include, for example, half life of a composition, the binding affinity of an Ab, the immunogenicity of a substance, the degree of 98P4B6 expression in the patient, the extent of circulating shed 98P4B6 antigen, the desired steady-state concentration level, frequency of treatment, and the influence of chemotherapeutic or other agents used in combination with the treatment method of the invention, as well as the health status of a particular patent. Non-limiting preferred human unit doses are, for example, 500 µg -1 mg, 1 mg-50 mg, 50 mg-100 mg, 100 mg-200 mg, 200 mg-300 mg, 400 mg-500 mg, 500 mg-600 mg, 600 mg-700 mg, 700 mg-800mg, 800 mg-900 mg, 900 mg-1 g, or 1 mg-700 mg. In certain embodiments, the dose is in a range of 2-5 mg/kg body weight, e.g., with follow on weekly doses of 1-3 mg/kg; 0.5 mg, 1, 2, 3, 4, 5, 6, 7, 8, 9, 10 mg/kg body weight followed, e.g., in two, three or four weeks by weekly doses; 0.5-10 mg/kg body weight, e.g., followed in two, three or four weeks by weekly doses; 225, 250, 275, 300, 325, 350, 375, 400 mg m$^2$ of body area weekly; 1-600 mg m$^2$ of body area weekly; 225-400 mg m$^2$ of body area weekly; these does can be followed by weekly doses for 2, 3, 4, 5, 6, 7, 8, 9, 19, 11, 12 or more weeks.

In one embodiment, human unit dose forms of polynucleotides comprise a suitable dosage range or effective amount that provides any therapeutic effect. As appreciated by one of ordinary skill in the art a therapeutic effect depends on a number of factors, including the sequence of the polynucleotide, molecular weight of the polynucleotide and route of administration. Dosages are generally selected by the physician or other health care professional in accordance with a variety of parameters known in the art, such as severity of symptoms, history of the patient and the like. Generally, for a polynucleotide of about 20 bases, a dosage range may be selected from, for example, an independently selected lower limit such as about 0.1, 0.25, 0.5, 1, 2, 5, 10, 20, 30, 40, 50, 60, 70, 80, 90, 100, 200, 300, 400 or 500 mg/kg up to an independently selected upper limit, greater than the lower limit, of about 60, 80, 100, 200, 300, 400, 500, 750, 1000, 1500, 2000, 3000, 4000, 5000, 6000, 7000, 8000, 9000 or 10,000 mg/kg. For example, a dose may be about any of the following: 0.1 to 100 mg/kg, 0.1 to 50 mg/kg, 0.1 to 25 mg/kg, 0.1 to 10 mg/kg, 1 to 500 mg/kg, 100 to 400 mg/kg, 200 to 300 mg/kg, 1 to 100 mg/kg, 100 to 200 mg/kg, 300 to 400 mg/kg, 400 to 500 mg/kg, 500 to 1000 mg/kg, 500 to 5000 mg/kg, or 500 to 10,000 mg/kg. Generally, parenteral routes of administration may require higher doses of polynucleotide compared to more direct application to the nucleotide to diseased tissue, as do polynucleotides of increasing length.

In one embodiment, human unit dose forms of T-cells comprise a suitable dosage range or effective amount that provides any therapeutic effect. As appreciated by one of ordinary skill in the art, a therapeutic effect depends on a number of factors. Dosages are generally selected by the physician or other health care professional in accordance with a variety of parameters known in the art, such as severity of symptoms, history of the patient and the like. A dose may be about $10^4$ cells to about $10^6$ cells, about $10^6$ cells to about $10^8$ cells, about $10^8$ to about $10^{11}$ cells, or about $10^8$ to about $5 \times 10^{10}$ cells. A dose may also about $10^6$ cells/m$^2$ to about $10^{10}$ cells/m$^2$, or about $10^6$ cells/m$^2$ to about $10^8$ cells/m$^2$.

Proteins(s) of the invention, and/or nucleic acids encoding the protein(s), can also be administered via liposomes, which may also serve to: 1) target the proteins(s) to a particular tissue, such as lymphoid issue; 2) to target selectively to diseases cells; or, 3) to increase the half-life of the peptide composition. Liposomes include emulsions, foams, micelles, insoluble monolayers, liquid crystals, phospholipid dispersions, lamellar layers and the like. In these preparations, the peptide to be delivered is incorporated as part of a liposome, alone or in conjunction with a molecule which binds to a receptor prevalent among lymphoid cells, such as monoclonal antibodies which bind to the CD45 antigen, or with other therapeutic or immunogenic compositions. Thus, liposomes either filled or decorated with a desired peptide of the invention can be directed to the site of lymphoid cells, where the liposomes then deliver the peptide compositions. Liposomes for use in accordance with the invention are formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka, et al., *Ann. Rev. Biophys. Bioeng.* 9:467 (1980), and U.S. Pat. Nos. 4,235,871, 4,501,728, 4,837,028, and 5,019,369.

For targeting cells of the immune system, a ligand to be incorporated into the liposome can include, e.g., antibodies or fragments thereof specific for cell surface determinants of the desired immune system cells. A liposome suspension containing a peptide may be administered intravenously, locally, topically, etc. in a dose which varies according to, inter alia, the manner of administration, the peptide being delivered, and the stage of the disease being treated.

For solid compositions, conventional nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10-95% of active ingredient, that is, one or more peptides of the invention, and more preferably at a concentration of 25%-75%.

For aerosol administration, immunogenic peptides are preferably supplied in finely divided form along with a surfactant and propellant. Typical percentages of peptides are about 0.01%-20% by weight, preferably about 1%-i 0%. The surfactant must, of course, be nontoxic, and preferably soluble in the propellant. Representative of such agents are the esters or partial esters of fatty acids containing from about 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute about 0.1%-20% by weight of the composition, preferably about 0.25-5%. The balance of the composition is ordinarily propellant. A carrier can also be included, as desired, as with, e.g., lecithin for intranasal delivery.

XI.) Diagnostic and Prognostic Embodiments of 98P4B6.

As disclosed herein, 98P4B6 polynucleotides, polypeptides, reactive cytotoxic T cells (CTL), reactive helper T cells (HTL) and anti-polypeptide antibodies are used in well known diagnostic, prognostic and therapeutic assays that examine conditions associated with dysregulated cell growth such as cancer, in particular the cancers listed in Table I (see, e.g., both its specific pattern of tissue expression as well as its overexpression in certain cancers as described for example in the Example entitled "Expression analysis of 98P4B6 in normal tissues, and patient specimens").

98P4B6 can be analogized to a prostate associated antigen PSA, the archetypal marker that has been used by medical practitioners for years to identify and monitor the presence of prostate cancer (see, e.g., Merrill et al., J. Urol. 163(2): 503-5120 (2000); Polascik et al., J. Urol. Aug; 162(2):293-306 (1999) and Fortier et al., J. Nat. Cancer Inst. 91(19): 1635-1640(1999)). A variety of other diagnostic markers are also used in similar contexts including p53 and K-ras (see, e.g., Tulchinsky et al., Int J Mol Med 1999 Jul. 4(1):99-102 and Minimoto et al., Cancer Detect Prev 2000;24(1):1-12).

Therefore, this disclosure of 98P4B6 polynucleotides and polypeptides (as well as 98P4B6 polynucleotide probes and anti-98P4B6 antibodies used to identify the presence of these molecules) and their properties allows skilled artisans to utilize these molecules in methods that are analogous to those used, for example, in a variety of diagnostic assays directed to examining conditions associated with cancer.

Typical embodiments of diagnostic methods which utilize the 98P4B6 polynucleotides, polypeptides, reactive T cells and antibodies are analogous to those methods from well-established diagnostic assays, which employ, e.g., PSA polynucleotides, polypeptides, reactive T cells and antibodies. For example, just as PSA polynucleotides are used as probes (for example in Northern analysis, see, e.g., Sharief et al., Biochem. Mol. Biol. Int. 33(3):567-74(1994)) and primers (for example in PCR analysis, see, e.g., Okegawa et al., J. Urol. 163(4): 1189-1190 (2000)) to observe the presence and/or the level of PSA mRNAs in methods of monitoring PSA overexpression or the metastasis of prostate cancers, the 98P4B6 polynucleotides described herein can be utilized in the same way to detect 98P4B6 overexpression or the metastasis of prostate and other cancers expressing this gene. Alternatively, just as PSA polypeptides are used to generate antibodies specific for PSA which can then be used to observe the presence and/or the level of PSA proteins in methods to monitor PSA protein overexpression (see, e.g., Stephan et al., Urology 55(4):560-3 (2000)) or the metastasis of prostate cells (see, e.g., Alanen et al., Pathol. Res. Pract. 192(3):233-7 (1996)), the 98P4B6 polypeptides described herein can be utilized to generate antibodies for use in detecting 98P4B6 overexpression or the metastasis of prostate cells and cells of other cancers expressing this gene.

Specifically, because metastases involves the movement of cancer cells from an organ of origin (such as the lung or prostate gland etc.) to a different area of the body (such as a lymph node), assays which examine a biological sample for the presence of cells expressing 98P4B6 polynucleotides and/or polypeptides can be used to provide evidence of metastasis. For example, when a biological sample from tissue that does not normally contain 98P4B6-expressing cells (lymph node) is found to contain 98P4B6-expressing cells such as the 98P4B6 expression seen in LAPC4 and LAPC9, xenografts isolated from lymph node and bone metastasis, respectively, this finding is indicative of metastasis.

Alternatively 98P4B6 polynucleotides and/or polypeptides can be used to provide evidence of cancer, for example, when cells in a biological sample that do not normally express 98P4B6 or express 98P4B6 at a different level are found to express 98P4B6 or have an increased expression of 98P4B6 (see, e.g., the 98P4B6 expression in the cancers listed in Table I and in patient samples etc. shown in the accompanying Figures). In such assays, artisans may further wish to generate supplementary evidence of metastasis by testing the biological sample for the presence of a second tissue restricted marker (in addition to 98P4B6) such as PSA, PSCA etc. (see, e.g., Alanen et al., Pathol. Res. Pract. 192(3): 233-237 (1996)).

Just as PSA polynucleotide fragments and polynucleotide variants are employed by skilled artisans for use in methods of monitoring PSA, 98P4B6 polynucleotide fragments and polynucleotide variants are used in an analogous manner. In particular, typical PSA polynucleotides used in methods of monitoring PSA are probes or primers which consist of fragments of the PSA cDNA sequence. Illustrating this, primers used to PCR amplify a PSA polynucleotide must include less than the whole PSA sequence to function in the polymerase chain reaction. In the context of such PCR reactions, skilled artisans generally create a variety of different polynucleotide fragments that can be used as primers in order to amplify different portions of a polynucleotide of interest or to optimize amplification reactions (see, e.g., Caetano-Anolles, G. Biotechniques 25(3): 472476, 478-480 (1998); Robertson et al., Methods Mol. Biol. 98:121-154 (1998)). An additional illustration of the use of such fragments is provided in the Example entitled "Expression analysis of 98P4B6 in normal tissues, and patient specimens," where a 98P4B6 polynucleotide fragment is used as a probe to show the expression of 98P4B6 RNAs in cancer cells. In addition, variant polynucleotide sequences are typically used as primers and probes for the corresponding mRNAs in PCR and Northern analyses (see, e.g., Sawai et al., Fet al Diagn. Ther. 1996 Nov-Dec 11(6):407-13 and Current Protocols In Molecular Biology, Volume 2, Unit 2, Frederick M. Ausubel et el. eds., 1995)). Polynucleotide fragments and variants are useful in this context where they are capable of binding to a target polynucleotide sequence (e.g., a 98P4B6 polynucleotide shown in FIG. 2 or variant thereof) under conditions of high stringency.

Furthermore, PSA polypeptides which contain an epitope that can be recognized by an antibody or T cell that specifically binds to that epitope are used in methods of monitoring PSA. 98P4B6 polypeptide fragments and polypeptide analogs or variants can also be used in an analogous manner. This practice of using polypeptide fragments or polypeptide variants to generate antibodies (such as anti-PSA antibodies or T cells) is typical in the art with a wide variety of systems such as fusion proteins being used by practitioners (see, e.g., Current Protocols In Molecular Biology, Volume 2, Unit 16, Frederick M. Ausubel et al. eds., 1995). In this context, each epitope(s) functions to provide the architecture with which an antibody or T cell is reactive. Typically, skilled artisans create a variety of different polypeptide fragments that can be used in order to generate immune responses specific for different portions of a polypeptide of interest (see, e.g., U.S. Pat. No. 5,840,501 and U.S. Pat. No. 5,939,533). For example it may be preferable to utilize a polypeptide comprising one of the 98P4B6 biological motifs discussed herein or a motif-bearing subsequence which is readily identified by one of skill in the art based on motifs available in the art. Polypeptide fragments, variants or analogs are typically useful in this context as long as they comprise an epitope capable of generating an antibody or T cell specific for a target polypeptide sequence (e.g. a 98P4B6 polypeptide shown in FIG. 3).

As shown herein, the 98P4B6 polynucleotides and polypeptides (as well as the 98P4B6 polynucleotide probes and anti-98P4B6 antibodies or T cells used to identify the presence of these molecules) exhibit specific properties that make them useful in diagnosing cancers such as those listed in Table I. Diagnostic assays that measure the presence of 98P4B6 gene products, in order to evaluate the presence or onset of a disease condition described herein, such as prostate cancer, are used to identify patients for preventive measures or further monitoring, as has been done so successfully with PSA. Moreover, these materials satisfy a need in the art for molecules having similar or complementary characteristics to PSA in situations where, for example, a definite diagnosis of metastasis of prostatic origin cannot be made on the basis of a test for PSA alone (see, e.g., Alanen et al., Pathol. Res. Pract. 192(3): 233-237 (1996)), and consequently, materials such as 98P4B6 polynucleotides and polypeptides (as well as the 98P4B6 polynucleotide probes and anti-98P4B6 antibodies used to identify the presence of these molecules) need to be employed to confirm a metastases of prostatic origin.

Finally, in addition to their use in diagnostic assays, the 98P4B6 polynucleotides disclosed herein have a number of other utilities such as their use in the identification of oncogenetic associated chromosomal abnormalities in the chromosomal region to which the 98P4B6 gene maps (see the Example entitled "Chromosomal Mapping of 98P4B6" below). Moreover, in addition to their use in diagnostic assays, the 98P4B6-related proteins and polynucleotides disclosed herein have other utilities such as their use in the forensic analysis of tissues of unknown origin (see, e.g., Takahama K Forensic Sci Int 1996 Jun. 28;80(1-2): 63-9).

Additionally, 98P4B6-related proteins or polynucleotides of the invention can be used to treat a pathologic condition characterized by the over-expression of 98P4B6. For example, the amino acid or nucleic acid sequence of FIG. 2 or FIG. 3, or fragments of either, can be used to generate an immune response to a 98P4B6 antigen. Antibodies or other molecules that react with 98P4B6 can be used to modulate the function of this molecule, and thereby provide a therapeutic benefit.

XII.) Inhibition of 98P4B6 Protein Function

The invention includes various methods and compositions for inhibiting the binding of 98P4B6 to its binding partner or its association with other protein(s) as well as methods for inhibiting 98P4B6 function.

XII.A.) Inhibition of 98P4B6 With Intracellular Antibodies

In one approach, a recombinant vector that encodes single chain antibodies that specifically bind to 98P4B6 are introduced into 98P4B6 expressing cells via gene transfer technologies. Accordingly, the encoded single chain anti-98P4B6 antibody is expressed intracellularly, binds to 98P4B6 protein, and thereby inhibits its function. Methods for engineering such intracellular single chain antibodies are well known. Such intracellular antibodies, also known as "intrabodies", are specifically targeted to a particular compartment within the cell, providing control over where the inhibitory activity of the treatment is focused. This technology has been successfully applied in the art (for review, see Richardson and Marasco, 1995, TIBTECH vol. 13). Intrabodies have been shown to virtually eliminate the expression of otherwise abundant cell surface receptors (see, e.g., Richardson et al., 1995, Proc. Natl. Acad. Sci. USA 92: 3137-3141; Beerli et al., 1994, J. Biol. Chem. 289: 23931-23936; Deshane et a., 1994, Gene Ther. 1: 332-337).

Single chain antibodies comprise the variable domains of the heavy and light chain joined by a flexible linker polypeptide, and are expressed as a single polypeptide. Optionally, single chain antibodies are expressed as a single chain variable region fragment joined to the light chain constant region. Well-known intracellular trafficking signals are engineered into recombinant polynucleotide vectors encoding such single chain antibodies in order to target precisely the intrabody to the desired intracellular compartment. For example, intrabodies targeted to the endoplasmic reticulum (ER) are engineered to incorporate a leader peptide and, optionally, a C-terminal ER retention signal, such as the KDEL amino acid motif. Intrabodies intended to exert activity in the nucleus are engineered to include a nuclear localization signal. Lipid moieties are joined to intrabodies in order to tether the intrabody to the cytosolic side of the plasma membrane. Intrabodies can also be targeted to exert function in the cytosol. For example, cytosolic intrabodies are used to sequester factors within the cytosol, thereby preventing them from being transported to their natural cellular destination.

In one embodiment, intrabodies are used to capture 98P4B6 in the nucleus, thereby preventing its activity within the nucleus. Nuclear targeting signals are engineered into such 98P4B6 intrabodies in order to achieve the desired targeting. Such 98P4B6 intrabodies are designed to bind specifically to a particular 98P4B6 domain. In another embodiment, cytosolic intrabodies that specifically bind to a 98P4B6 protein are used to prevent 98P4B6 from gaining access to the nucleus, thereby preventing it from exerting any biological activity within the nucleus (e.g., preventing 98P4B6 from forming transcription complexes with other factors).

In order to specifically direct the expression of such intrabodies to particular cells, the transcription of the intrabody is placed under the regulatory control of an appropriate tumor-specific promoter and/or enhancer. In order to target intrabody expression specifically to prostate, for example, the PSA promoter and/or promoter/enhancer can be utilized (See, for example, U.S. Pat. No. 5,919,652 issued 6 Jul. 1999).

XII.B.) Inhibition of 98P4B6 with Recombinant Proteins

In another approach, recombinant molecules bind to 98P4B6 and thereby inhibit 98P4B6 function. For example, these recombinant molecules prevent or inhibit 98P4B6 from accessing/binding to its binding partner(s) or associating with other protein(s). Such recombinant molecules can, for example, contain the reactive part(s) of a 98P4B6 specific antibody molecule. In a particular embodiment, the 98P4B6 binding domain of a 98P4B6 binding partner is engineered into a dimeric fusion protein, whereby the fusion protein comprises two 98P4B6 ligand binding domains linked to the Fc portion of a human IgG, such as human IgG1. Such IgG portion can contain, for example, the CH2 and CH3 domains and the hinge region, but not the CH1 domain. Such dimeric fusion proteins are administered in soluble form to patients suffering from a cancer associated with the expression of 98P4B6, whereby the dimeric fusion protein specifically binds to 98P4B6 and blocks 98P4B6 interaction with a binding partner. Such dimeric fusion proteins are further combined into multimeric proteins using known antibody linking technologies.

XII.C.) Inhibition of 98P4B6 Transcription or Translation

The present invention also comprises various methods and compositions for inhibiting the transcription of the 98P4B6 gene. Similarly, the invention also provides methods and compositions for inhibiting the translation of 98P4B6 mRNA into protein.

In one approach, a method of inhibiting the transcription of the 98P4B6 gene comprises contacting the 98P4B6 gene with a 98P4B6 antisense polynucleotide. In another approach, a method of inhibiting 98P4B6 mRNA translation comprises contacting a 98P4B6 mRNA with an antisense polynucleotide. In another approach, a 98P4B6 specific ribozyme is used to cleave a 98P4B6 message, thereby inhibiting translation. Such antisense and ribozyme based methods can also be directed to the regulatory regions of the 98P4B6 gene, such as 98P4B6 promoter and/or enhancer elements. Similarly, proteins capable of inhibiting a 98P4B6 gene transcription factor are used to inhibit 98P4B6 mRNA transcription. The various polynucleotides and compositions useful in the aforementioned methods have been described above. The use of antisense and ribozyme molecules to inhibit transcription and translation is well known in the art.

Other factors that inhibit the transcription of 98P4B6 by interfering with 98P4B6 transcriptional activation are also useful to treat cancers expressing 98P4B6. Similarly, factors that interfere with 98P4B6 processing are useful to treat cancers that express 98P4B6. Cancer treatment methods utilizing such factors are also within the scope of the invention.

XII.D.) General Considerations for Therapeutic Strategies

Gene transfer and gene therapy technologies can be used to deliver therapeutic polynucleotide molecules to tumor cells synthesizing 98P4B6 (i.e., antisense, ribozyme, polynucleotides encoding intrabodies and other 98P4B6 inhibitory molecules). A number of gene therapy approaches are known in the art. Recombinant vectors encoding 98P4B6 antisense polynucleotides, ribozymes, factors capable of interfering with 98P4B6 transcription, and so forth, can be delivered to target tumor cells using such gene therapy approaches.

The above therapeutic approaches can be combined with any one of a wide variety of surgical, chemotherapy or radiation therapy regimens. The therapeutic approaches of the invention can enable the use of reduced dosages of chemotherapy (or other therapies) and/or less frequent administration, an advantage for all patients and particularly for those that do not tolerate the toxicity of the chemotherapeutic agent well.

The anti-tumor activity of a particular composition (e.g., antisense, ribozyme, intrabody), or a combination of such compositions, can be evaluated using various in vitro and in vivo assay systems. In vitro assays that evaluate therapeutic activity include cell growth assays, soft agar assays and other assays indicative of tumor promoting activity, binding assays capable of determining the extent to which a therapeutic composition will inhibit the binding of 98P4B6 to a binding partner, etc.

In vivo, the effect of a 98P4B6 therapeutic composition can be evaluated in a suitable animal model. For example, xenogenic prostate cancer models can be used, wherein human prostate cancer explants or passaged xenograft tissues are introduced into immune compromised animals, such as nude or SCID mice (Klein et al., 1997, Nature Medicine 3: 402-408). For example, PCT Patent Application WO98/16628 and U.S. Pat. No. 6,107,540 describe various xenograft models of human prostate cancer capable of recapitulating the development of primary tumors, micrometastasis, and the formation of osteoblastic metastases characteristic of late stage disease. Efficacy can be predicted using assays that measure inhibition of tumor formation, tumor regression or metastasis, and the like.

In vivo assays that evaluate the promotion of apoptosis are useful in evaluating therapeutic compositions. In one embodiment, xenografts from tumor bearing mice treated with the therapeutic composition can be examined for the presence of apoptotic foci and compared to untreated control xenograft-bearing mice. The extent to which apoptotic foci are found in the tumors of the treated mice provides an indication of the therapeutic efficacy of the composition.

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences 16$^{th}$ Edition, A. Osal., Ed., 1980).

Therapeutic formulations can be solubilized and administered via any route capable of delivering the therapeutic composition to the tumor site. Potentially effective routes of administration include, but are not limited to, intravenous, parenteral, intraperitoneal, intramuscular, intratumor, intradermal, intraorgan, orthotopic, and the like. A preferred formulation for intravenous injection comprises the therapeutic composition in a solution of preserved bacteriostatic water, sterile unpreserved water, and/or diluted in polyvinylchloride or polyethylene bags containing 0.9% sterile Sodium Chloride for Injection, USP. Therapeutic protein preparations can be lyophilized and stored as sterile powders, preferably under vacuum, and then reconstituted in bacteriostatic water (containing for example, benzyl alcohol preservative) or in sterile water prior to injection.

Dosages and administration protocols for the treatment of cancers using the foregoing methods will vary with the method and the target cancer, and will generally depend on a number of other factors appreciated in the art.

XIII.) Identification, Characterization and Use of Modulators of 98P4B6

Methods to Identify and Use Modulators

In one embodiment, screening is performed to identify modulators that induce or suppress a particular expression profile, suppress or induce specific pathways, preferably generating the associated phenotype thereby. In another embodiment, having identified differentially expressed genes important in a particular state; screens are performed to identify modulators that alter expression of individual genes, either increase or decrease. In another embodiment, screening is performed to identify modulators that alter a biological function of the expression product of a differentially expressed gene. Again, having identified the importance of a gene in a particular state, screens are performed to identify agents that bind and/or modulate the biological activity of the gene product.

In addition, screens are done for genes that are induced in response to a candidate agent. After identifying a modulator (one that suppresses a cancer expression pattern leading to a normal expression pattern, or a modulator of a cancer gene that leads to expression of the gene as in normal tissue) a screen is performed to identify genes that are specifically modulated in response to the agent. Comparing expression profiles between normal tissue and agent-treated cancer tissue reveals genes that are not expressed in normal tissue or cancer tissue, but are expressed in agent treated tissue, and vice versa. These agent-specific sequences are identified and used by methods described herein for cancer genes or proteins. In particular these sequences and the proteins they encode are used in marking or identifying agent-treated cells. In addition, antibodies are raised against the agent-induced proteins and used to target novel therapeutics to the treated cancer tissue sample.

Modulator-related Identification and Screening Assays:

Gene Expression-related Assays

Proteins, nucleic acids, and antibodies of the invention are used in screening assays. The cancer-associated proteins, antibodies, nucleic acids, modified proteins and cells containing these sequences are used in screening assays, such as evaluating the effect of drug candidates on a "gene expression profile," expression profile of polypeptides or alteration of biological function. In one embodiment, the expression profiles are used, preferably in conjunction with high throughput screening techniques to allow monitoring for expression profile genes after treatment with a candidate agent (e.g., Davis, GF, et al, J Biol Screen 7:69 (2002); Zlokamik, et al., Science 279:84-8 (1998); Heid, Genome Res 6:986-94,1996).

The cancer proteins, antibodies, nucleic acids, modified proteins and cells containing the native or modified cancer proteins or genes are used in screening assays. That is, the present invention comprises methods for screening for compositions which modulate the cancer phenotype or a physiological function of a cancer protein of the invention. This is done on a gene itself or by evaluating the effect of drug candidates on a "gene expression profile" or biological function. In one embodiment, expression profiles are used, preferably in conjunction with high throughput screening techniques to allow monitoring after treatment with a candidate agent, see Zlokamik, supra.

A variety of assays are executed directed to the genes and proteins of the invention. Assays are run on an individual nucleic acid or protein level. That is, having identified a particular gene as up regulated in cancer, test compounds are screened for the ability to modulate gene expression or for binding to the cancer protein of the invention. "Modulation" in this context includes an increase or a decrease in gene expression. The preferred amount of modulation will depend on the original change of the gene expression in normal versus tissue undergoing cancer, with changes of at least 10%, preferably 50%, more preferably 100-300%, and in some embodiments 300-1000% or greater. Thus, if a gene exhibits a 4-fold increase in cancer tissue compared to normal tissue, a decrease of about four-fold is often desired; similarly, a 10-fold decrease in cancer tissue compared to normal tissue a target value of a 10-fold increase in expression by the test compound is often desired. Modulators that exacerbate the type of gene expression seen in cancer are also useful, e.g., as an upregulated target in further analyses.

The amount of gene expression is monitored using nucleic acid probes and the quantification of gene expression levels, or, alternatively, a gene product itself is monitored, e.g., through the use of antibodies to the cancer protein and standard immunoassays. Proteomics and separation techniques also allow for quantification of expression.

Expression Monitoring to Identify Compounds that Modify Gene Expression

In one embodiment, gene expression monitoring, i.e., an expression profile, is monitored simultaneously for a number of entities. Such profiles will typically involve one or more of the genes of FIG. 2. In this embodiment, e.g., cancer nucleic acid probes are attached to biochips to detect and quantify cancer sequences in a particular cell. Alternatively, PCR can be used. Thus, a series, e.g., wells of a microtiter plate, can be used with dispensed primers in desired wells. A PCR reaction can then be performed and analyzed for each well.

Expression monitoring is performed to identify compounds that modify the expression of one or more cancer-associated sequences, e.g., a polynucleotide sequence set out in FIG. 2. Generally, a test modulator is added to the cells prior to analysis. Moreover, screens are also provided to identify agents that modulate cancer, modulate cancer proteins of the invention, bind to a cancer protein of the invention, or interfere with the binding of a cancer protein of the invention and an antibody or other binding partner.

In one embodiment, high throughput screening methods involve providing a library containing a large number of potential therapeutic compounds (candidate compounds). Such "combinatorial chemical libraries" are then screened in one or more assays to identify those library members (particular chemical species or subclasses) that display a desired characteristic activity. The compounds thus identified can serve as conventional "lead compounds," as compounds for screening, or as therapeutics.

In certain embodiments, combinatorial libraries of potential modulators are screened for an ability to bind to a cancer polypeptide or to modulate activity. Conventionally, new chemical entities with useful properties are generated by identifying a chemical compound (called a "lead compound") with some desirable property or activity, e.g., inhibiting activity, creating variants of the lead compound, and evaluating the property and activity of those variant compounds. Often, high throughput screening (HTS) methods are employed for such an analysis.

As noted above, gene expression monitoring is conveniently used to test candidate modulators (e.g., protein, nucleic acid or small molecule). After the candidate agent has been added and the cells allowed to incubate for a period, the sample containing a target sequence to be analyzed is, e.g., added to a biochip.

If required, the target sequence is prepared using known techniques. For example, a sample is treated to lyse the cells, using known lysis buffers, electroporation, etc., with purification and/or amplification such as PCR performed as appropriate. For example, an in vitro transcription with labels covalently attached to the nucleotides is performed. Generally, the nucleic acids are labeled with biotin-FITC or PE, or with cy3 or cy5.

The target sequence can be labeled with, e.g., a fluorescent, a chemiluminescent, a chemical, or a radioactive signal, to provide a means of detecting the target sequence's specific binding to a probe. The label also can be an enzyme, such as alkaline phosphatase or horseradish peroxidase, which when provided with an appropriate substrate produces a product that is detected. Alternatively, the label is a labeled compound or small molecule, such as an enzyme inhibitor, that binds but is not catalyzed or altered by the enzyme. The label also can be a moiety or compound, such as, an epitope tag or biotin which specifically binds to streptavidin. For the example of biotin, the streptavidin is labeled as described above, thereby, providing a detectable signal for the bound target sequence. Unbound labeled streptavidin is typically removed prior to analysis.

As will be appreciated by those in the art, these assays can be direct hybridization assays or can comprise "sandwich assays", which include the use of multiple probes, as is generally outlined in U.S. Pat. Nos. 5,681,702; 5,597,909; 5,545,730; 5,594,117; 5,591,584; 5,571,670; 5,580,731; 5,571,670; 5,591,584; 5,624,802; 5,635,352; 5,594,118; 5,359,100; 5,124,246; and 5,681,697. In this embodiment, in general, the target nucleic acid is prepared as outlined above, and then added to the biochip comprising a plurality of nucleic acid probes, under conditions that allow the formation of a hybridization complex.

A variety of hybridization conditions are used in the present invention, including high, moderate and low stringency conditions as outlined above. The assays are generally run under stringency conditions which allow formation of the label probe hybridization complex only in the presence of target. Stringency can be controlled by altering a step parameter that is a thermodynamic variable, including, but not limited to, temperature, formamide concentration, salt concentration, chaotropic salt concentration pH, organic solvent concentration, etc. These parameters may also be used to control non-specific binding, as is generally outlined in U.S. Pat. No. 5,681,697. Thus, it can be desirable to perform certain steps at higher stringency conditions to reduce non-specific binding.

The reactions outlined herein can be accomplished in a variety of ways. Components of the reaction can be added simultaneously, or sequentially, in different orders, with preferred embodiments outlined below. In addition, the reaction may include a variety of other reagents. These include salts, buffers, neutral proteins, e.g. albumin, detergents, etc. which can be used to facilitate optimal hybridization and detection, and/or reduce nonspecific or background interactions. Reagents that otherwise improve the efficiency of the assay, such as protease inhibitors, nuclease inhibitors, anti-microbial agents, etc., may also be used as appropriate, depending on the sample preparation methods and purity of the target. The assay data are analyzed to determine the expression levels of individual genes, and changes in expression levels as between states, forming a gene expression profile.

Biological Activity-related Assays

The invention provides methods identify or screen for a compound that modulates the activity of a cancer-related gene or protein of the invention. The methods comprise adding a test compound, as defined above, to a cell comprising a cancer protein of the invention. The cells contain a recombinant nucleic acid that encodes a cancer protein of the invention. In another embodiment, a library of candidate agents is tested on a plurality of cells.

In one aspect, the assays are evaluated in the presence or absence or previous or subsequent exposure of physiological signals, e.g. hormones, antibodies, peptides, antigens, cytokines, growth factors, action potentials, pharmacological agents including chemotherapeutics, radiation, carcinogenics, or other cells (i.e., cell-cell contacts). In another example, the determinations are made at different stages of the cell cycle process. In this way, compounds that modulate genes or proteins of the invention are identified. Compounds with pharmacological activity are able to enhance or interfere with the activity of the cancer protein of the invention. Once identified, similar structures are evaluated to identify critical structural features of the compound.

In one embodiment, a method of modulating (e.g., inhibiting) cancer cell division is provided; the method comprises administration of a cancer modulator. In another embodiment, a method of modulating (e.g., inhibiting) cancer is provided; the method comprises administration of a cancer modulator. In a further embodiment, methods of treating cells or individuals with cancer are provided; the method comprises administration of a cancer modulator.

In one embodiment, a method for modulating the status of a cell that expresses a gene of the invention is provided. As used herein status comprises such art-accepted parameters such as growth, proliferation, survival, function, apoptosis, senescence, location, enzymatic activity, signal transduction, etc. of a cell. In one embodiment, a cancer inhibitor is an antibody as discussed above. In another embodiment, the cancer inhibitor is an antisense molecule. A variety of cell growth, proliferation, and metastasis assays are known to those of skill in the art, as described herein.

High Throughput Screening to Identify Modulators

The assays to identify suitable modulators are amenable to high throughput screening. Preferred assays thus detect enhancement or inhibition of cancer gene transcription, inhibition or enhancement of polypeptide expression, and inhibition or enhancement of polypeptide activity.

In one embodiment, modulators evaluated in high throughput screening methods are proteins, often naturally occurring proteins or fragments of naturally occurring proteins. Thus, e.g., cellular extracts containing proteins, or random or directed digests of proteinaceous cellular extracts, are used. In this way, libraries of proteins are made for screening in the methods of the invention. Particularly preferred in this embodiment are libraries of bacterial, fungal, viral, and mammalian proteins, with the latter being preferred, and human proteins being especially preferred. Particularly useful test compound will be directed to the class of proteins to which the target belongs, e.g., substrates for enzymes, or ligands and receptors.

Use of Soft Agar Growth and Colony Formation to Identify and Characterize Modulators Normal cells require a solid substrate to attach and grow. When cells are transformed, they lose this phenotype and grow detached from the substrate. For example, transformed cells can grow in stirred suspension culture or suspended in semi-solid media, such as semi-solid or soft agar. The transformed cells, when transfected with tumor suppressor genes, can regenerate normal phenotype and once again require a solid substrate to attach to and grow. Soft agar growth or colony formation in assays are used to identify modulators of cancer sequences, which when expressed in host cells, inhibit abnormal cellular proliferation and transformation. A modulator reduces or eliminates the host cells' ability to grow suspended in solid or semisolid media, such as agar.

Techniques for soft agar growth or colony formation in suspension assays are described in Freshney, Culture of Animal Cells a Manual of Basic Technique (3rd ed., 1994). See also, the methods section of Garkavtsev et al. (1996), supra.

Evaluation of Contact Inhibition and Growth Density Limitation to Identify and Characterize Modulators Normal cells typically grow in a flat and organized pattern in cell culture until they touch other cells. When the cells touch one another, they are contact inhibited and stop growing. Transformed cells, however, are not contact inhibited and continue to grow to high densities in disorganized foci. Thus, transformed cells grow to a higher saturation density than corresponding normal cells. This is detected morphologically by the formation of a disoriented monolayer of cells or cells in foci. Alternatively, labeling index with ($^3$H)-thymidine at saturation density is used to measure density limitation of growth, similarly an MTT or Alamar blue assay will reveal proliferation capacity of cells and the ability of modulators to affect same. See Freshney (1994), supra. Transformed cells, when transfected with tumor suppressor genes, can regenerate a normal phenotype and become contact inhibited and would grow to a lower density.

In this assay, labeling index with $^3$H)-thymidine at saturation density is a preferred method of measuring density limitation of growth. Transformed host cells are transfected with a cancer-associated sequence and are grown for 24 hours at saturation density in non-limiting medium conditions. The percentage of cells labeling with ($^3$H)-thymidine is determined by incorporated cpm.

Contact independent growth is used to identify modulators of cancer sequences, which had led to abnormal cellular proliferation and transformation. A modulator reduces or eliminates contact independent growth, and returns the cells to a normal phenotype.

Evaluation of Growth Factor or Serum Dependence to Identify and Characterize Modulators Transformed cells have lower serum dependence than their normal counterparts (see, e.g., Temin, J. Natl. Cancer Inst. 37:167-175 (1966); Eagle et al., J. Exp. Med 131:836-879 (1970)); Freshney, supra. This is in part due to release of various growth factors by the transformed cells. The degree of growth factor or serum dependence of transformed host cells can be compared with that of control. For example, growth factor or serum dependence of a cell is monitored in methods to identify and characterize compounds that modulate cancer-associated sequences of the invention.

Use of Tumor-specific Marker Levels to Identify and Characterize Modulators

Tumor cells release an increased amount of certain factors (hereinafter "tumor specific markers") than their normal counterparts. For example, plasminogen activator (PA) is released from human glioma at a higher level than from normal brain cells (see, e.g., Gullino, Angiogenesis, Tumor Vascularization, and Potential Interference with Tumor Growth, in Biological Responses in Cancer, pp. 178-184 (Mihich (ed.) 1985)). Similarly, Tumor Angiogenesis Factor (TAF) is released at a higher level in tumor cells than their normal counterparts. See, e.g., Folkman, Angiogenesis and Cancer, Sem Cancer Biol. (1992)), while bFGF is released from endothelial tumors (Ensoli, B et al).

Various techniques which measure the release of these factors are described in Freshney (1994), supra. Also, see, Unkless et al., J. Biol. Chem. 249:4295-4305 (1974); Strickland & Beers, J. Biol. Chem. 251:5694-5702 (1976); Whur et al., Br. J. Cancer 42:305 312 (1980); Gullino, Angiogenesis, Tumor Vascularization, and Potential Interference with Tumor Growth, in Biological Responses in Cancer, pp. 178-184 (Mihich (ed.) 1985); Freshney, Anticancer Res. 5:111-130 (1985). For example, tumor specific marker levels are monitored in methods to identify and characterize compounds that modulate cancer-associated sequences of the invention.

Invasiveness into Matrigel to Identify and Characterize Modulators

The degree of invasiveness into Matrigel or an extracellular matrix constituent can be used as an assay to identify and characterize compounds that modulate cancer associated sequences. Tumor cells exhibit a positive correlation between malignancy and invasiveness of cells into Matrigel or some other extracellular matrix constituent. In this assay, tumorigenic cells are typically used as host cells. Expression of a tumor suppressor gene in these host cells would decrease invasiveness of the host cells. Techniques described in Cancer Res. 1999; 59:6010; Freshney (1994), supra, can be used. Briefly, the level of invasion of host cells is measured by using filters coated with Matrigel or some other extracellular matrix constituent. Penetration into the gel, or through to the distal side of the filter, is rated as invasiveness, and rated histologically by number of cells and distance moved, or by prelabeling the cells with $^{125}$I and counting the radioactivity on the distal side of the filter or bottom of the dish. See, e.g., Freshney (1984), supra.

Evaluation of Tumor Growth In Vivo to Identify and Characterize Modulators

Effects of cancer-associated sequences on cell growth are tested in transgenic or immune-suppressed organisms. Transgenic organisms are prepared in a variety of art-accepted ways. For example, knock-out transgenic organisms, e.g., mammals such as mice, are made, in which a cancer gene is disrupted or in which a cancer gene is inserted. Knock-out transgenic mice are made by insertion of a marker gene or other heterologous gene into the endogenous cancer gene site in the mouse genome via homologous recombination. Such mice can also be made by substituting the endogenous cancer gene with a mutated version of the cancer gene, or by mutating the endogenous cancer gene, e.g., by exposure to carcinogens.

To prepare transgenic chimeric animals, e.g., mice, a DNA construct is introduced into the nuclei of embryonic stem cells. Cells containing the newly engineered genetic lesion are injected into a host mouse embryo, which is re-implanted into a recipient female. Some of these embryos develop into chimeric mice that possess germ cells some of which are derived from the mutant cell line. Therefore, by breeding the chimeric mice it is possible to obtain a new line of mice containing the introduced genetic lesion (see, e.g., Capecchi et al., Science 244:1288 (1989)). Chimeric mice can be derived according to U.S. Pat. No. 6,365,797, issued 2 Apr. 2002; U.S. Pat. No. 6,107,540 issued 22 Aug. 2000; Hogan et al., Manipulating the Mouse Embryo: A laboratory Manual, Cold Spring Harbor Laboratory (1988) and Teratocarcinomas and Embryonic Stem Cells: A Practical Approach, Robertson, ed., IRL Press, Washington, D.C., (1987).

Alternatively, various immune-suppressed or immune-deficient host animals can be used. For example, a genetically athymic "nude" mouse (see, e.g., Giovanella et al., J. Natl. Cancer Inst. 52:921 (1974)), a SCID mouse, a thymectomized mouse, or an irradiated mouse (see, e.g., Bradley et al., Br. J. Cancer 38:263 (1978); Selby et al., Br. J. Cancer 41:52 (1980)) can be used as a host. Transplantable tumor cells (typically about $10^6$ cells) injected into isogenic hosts produce invasive tumors in a high proportion of cases, while normal cells of similar origin will not. In hosts which developed invasive tumors, cells expressing cancer-associated sequences are injected subcutaneously or orthotopically. Mice are then separated into groups, including control groups and treated experimental groups) e.g. treated with a modulator). After a suitable length of time, preferably 4-8 weeks, tumor growth is measured (e.g., by volume or by its two largest dimensions, or weight) and compared to the control. Tumors that have statistically significant reduction (using, e.g., Student's T test) are said to have inhibited growth.

In Vitro Assays to Identify and Characterize Modulators

Assays to identify compounds with modulating activity can be performed in vitro. For example, a cancer polypeptide is first contacted with a potential modulator and incubated for a suitable amount of time, e.g., from 0.5 to 48 hours. In one embodiment, the cancer polypeptide levels are determined in vitro by measuring the level of protein or mRNA. The level of protein is measured using immunoassays such as Western blotting, ELISA and the like with an antibody that selectively binds to the cancer polypeptide or a fragment thereof. For measurement of mRNA, amplification, e.g., using PCR, LCR, or hybridization assays, e.g., Northern hybridization, RNAse protection, dot blotting, are preferred. The level of protein or mRNA is detected using directly or indirectly labeled detection agents, e.g., fluorescently or radioactively labeled nucleic acids, radioactively or enzymatically labeled antibodies, and the like, as described herein.

Alternatively, a reporter gene system can be devised using a cancer protein promoter operably linked to a reporter gene such as luciferase, green fluorescent protein, CAT, or P-gal. The reporter construct is typically transfected into a cell. After treatment with a potential modulator, the amount of reporter gene transcription, translation, or activity is measured according to standard techniques known to those of skill in the art (Davis G F, supra; Gonzalez, J. & Negulescu, P. Curr. Opin. Biotechnol. 1998: 9:624).

As outlined above, in vitro screens are done on individual genes and gene products. That is, having identified a particular differentially expressed gene as important in a particular state, screening of modulators of the expression of the gene or the gene product itself is performed.

In one embodiment, screening for modulators of expression of specific gene(s) is performed. Typically, the expression of only one or a few genes is evaluated. In another embodiment, screens are designed to first find compounds that bind to differentially expressed proteins. These compounds are then evaluated for the ability to modulate differentially expressed activity. Moreover, once initial candidate compounds are identified, variants can be further screened to better evaluate structure activity relationships.

Binding Assays to Identify and Characterize Modulators

In binding assays in accordance with the invention, a purified or isolated gene product of the invention is generally used. For example, antibodies are generated to a protein of the invention, and immunoassays are run to determine the amount and/or location of protein. Alternatively, cells comprising the cancer proteins are used in the assays.

Thus, the methods comprise combining a cancer protein of the invention and a candidate compound such as a ligand, and determining the binding of the compound to the cancer protein of the invention. Preferred embodiments utilize the human cancer protein; animal models of human disease of can also be developed and used. Also, other analogous mammalian proteins also can be used as appreciated by those of skill in the art. Moreover, in some embodiments variant or derivative cancer proteins are used.

Generally, the cancer protein of the invention, or the ligand, is non-diffusibly bound to an insoluble support. The support can, e.g., be one having isolated sample receiving areas (a microtiter plate, an array, etc.). The insoluble supports can be made of any composition to which the compositions can be bound, is readily separated from soluble material, and is otherwise compatible with the overall method of screening. The surface of such supports can be solid or porous and of any convenient shape.

Examples of suitable insoluble supports include microtiter plates, arrays, membranes and beads. These are typically made of glass, plastic (e.g., polystyrene), polysaccharide, nylon, nitrocellulose, or Teflon™, etc. Microtiter plates and arrays are especially convenient because a large number of assays can be carried out simultaneously, using small amounts of reagents and samples. The particular manner of binding of the composition to the support is not crucial so long as it is compatible with the reagents and overall methods of the invention, maintains the activity of the composition and is nondiffusable. Preferred methods of binding include the use of antibodies which do not sterically block either the ligand binding site or activation sequence when attaching the protein to the support, direct binding to "sticky" or ionic supports, chemical crosslinking, the synthesis of the protein or agent on the surface, etc. Following binding of the protein or ligand/binding agent to the support, excess unbound material is removed by washing. The sample receiving areas may then be blocked through incubation with bovine serum albumin (BSA), casein or other innocuous protein or other moiety.

Once a cancer protein of the invention is bound to the support, and a test compound is added to the assay. Alternatively, the candidate binding agent is bound to the support and the cancer protein of the invention is then added. Binding agents include specific antibodies, non-natural binding agents identified in screens of chemical libraries, peptide analogs, etc.

Of particular interest are assays to identify agents that have a low toxicity for human cells. A wide variety of assays can be used for this purpose, including proliferation assays, cAMP assays, labeled in vitro protein-protein binding assays, electrophoretic mobility shift assays, immunoassays for protein binding, functional assays (phosphorylation assays, etc.) and the like.

A determination of binding of the test compound (ligand, binding agent, modulator, etc.) to a cancer protein of the invention can be done in a number of ways. The test compound can be labeled, and binding determined directly, e.g., by attaching all or a portion of the cancer protein of the invention to a solid support, adding a labeled candidate compound (e.g., a fluorescent label), washing off excess reagent, and determining whether the label is present on the solid support. Various blocking and washing steps can be utilized as appropriate.

In certain embodiments, only one of the components is labeled, e.g., a protein of the invention or ligands labeled. Alternatively, more than one component is labeled with different labels, e.g., $I^{125}$, for the proteins and a fluorophor for the compound. Proximity reagents, e.g., quenching or energy transfer reagents are also useful.

Competitive Binding to Identify and Characterize Modulators

In one embodiment, the binding of the "test compound" is determined by competitive binding assay with a "competitor." The competitor is a binding moiety that binds to the target molecule (e.g., a cancer protein of the invention). Competitors include compounds such as antibodies, peptides, binding partners, ligands, etc. Under certain circumstances, the competitive binding between the test compound and the competitor displaces the test compound. In one embodiment, the test compound is labeled. Either the test compound, the competitor, or both, is added to the protein for a time sufficient to allow binding. Incubations are performed at a temperature that facilitates optimal activity, typically between four and 40° C. Incubation periods are typically optimized, e.g., to facilitate rapid high throughput screening; typically between zero and one hour will be sufficient. Excess reagent is generally removed or washed away. The second component is then added, and the presence or absence of the labeled component is followed, to indicate binding.

In one embodiment, the competitor is added first, followed by the test compound. Displacement of the competitor is an indication that the test compound is binding to the cancer protein and thus is capable of binding to, and potentially modulating, the activity of the cancer protein. In this embodiment, either component can be labeled. Thus, e.g., if the competitor is labeled, the presence of label in the post-test compound wash solution indicates displacement by the test compound. Alternatively, if the test compound is labeled, the presence of the label on the support indicates displacement.

In an alternative embodiment, the test compound is added first, with incubation and washing, followed by the competitor. The absence of binding by the competitor indicates that the test compound binds to the cancer protein with higher affinity than the competitor. Thus, if the test compound is labeled, the presence of the label on the support, coupled with a lack of competitor binding, indicates that the test compound binds to and thus potentially modulates the cancer protein of the invention.

Accordingly, the competitive binding methods comprise differential screening to identity agents that are capable of modulating the activity of the cancer proteins of the invention. In this embodiment, the methods comprise combining a cancer protein and a competitor in a first sample. A second sample comprises a test compound, the cancer protein, and a competitor. The binding of the competitor is determined for both samples, and a change, or difference in binding between the two samples indicates the presence of an agent capable of binding to the cancer protein and potentially modulating its activity. That is, if the binding of the competitor is different in the second sample relative to the first sample, the agent is capable of binding to the cancer protein.

Alternatively, differential screening is used to identify drug candidates that bind to the native cancer protein, but cannot bind to modified cancer proteins. For example the structure of the cancer protein is modeled and used in rational drug design to synthesize agents that interact with that site, agents which generally do not bind to site-modified proteins. Moreover, such drug candidates that affect the activity of a native cancer protein are also identified by screening drugs for the ability to either enhance or reduce the activity of such proteins.

Positive controls and negative controls can be used in the assays. Preferably control and test samples are performed in at least triplicate to obtain statistically significant results. Incubation of all samples occurs for a time sufficient to allow for the binding of the agent to the protein. Following incubation, samples are washed free of non-specifically bound material and the amount of bound, generally labeled agent determined. For example, where a radiolabel is employed, the samples can be counted in a scintillation counter to determine the amount of bound compound.

A variety of other reagents can be included in the screening assays. These include reagents like salts, neutral proteins, e.g. albumin, detergents, etc. which are used to facilitate optimal protein-protein binding and/or reduce non-specific or background interactions. Also reagents that otherwise improve the efficiency of the assay, such as protease inhibitors, nuclease inhibitors, anti-microbial agents, etc., can be used. The mixture of components is added in an order that provides for the requisite binding.

Use of Polynucleotides to Down-regulate or Inhibit a Protein of the Invention.

Polynucleotide modulators of cancer can be introduced into a cell containing the target nucleotide sequence by formation of a conjugate with a ligand-binding molecule, as described in WO 91/04753. Suitable ligand-binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell. Alternatively, a polynucleotide modulator of cancer can be introduced into a cell containing the target nucleic acid sequence, e.g., by formation of a polynucleotide-lipid complex, as described in WO 90/10448. It is understood that the use of antisense molecules or knock out and knock in models may also be used in screening assays as discussed above, in addition to methods of treatment.

Inhibitory and Antisense Nucleotides

In certain embodiments, the activity of a cancer-associated protein is down-regulated, or entirely inhibited, by the use of antisense polynucleotide or inhibitory small nuclear RNA (snRNA), i.e., a nucleic acid complementary to, and which can preferably hybridize specifically to, a coding mRNA nucleic acid sequence, e.g., a cancer protein of the invention, mRNA, or a subsequence thereof. Binding of the antisense polynucleotide to the mRNA reduces the translation and/or stability of the mRNA.

In the context of this invention, antisense polynucleotides can comprise naturally occurring nucleotides, or synthetic species formed from naturally occurring subunits or their close homologs. Antisense polynucleotides may also have altered sugar moieties or inter-sugar linkages. Exemplary among these are the phosphorothioate and other sulfur containing species which are known for use in the art. Analogs are comprised by this invention so long as they function effectively to hybridize with nucleotides of the invention. See, e.g., Isis Pharmaceuticals, Carlsbad, Calif.; Sequitor, Inc., Natick, Mass.

Such antisense polynucleotides can readily be synthesized using recombinant means, or can be synthesized in vitro. Equipment for such synthesis is sold by several vendors, including Applied Biosystems. The preparation of other oligonucleotides such as phosphorothioates and alkylated derivatives is also well known to those of skill in the art.

Antisense molecules as used herein include antisense or sense oligonucleotides. Sense oligonucleotides can, e.g., be employed to block transcription by binding to the anti-sense strand. The antisense and sense oligonucleotide comprise a single stranded nucleic acid sequence (either RNA or DNA) capable of binding to target mRNA (sense) or DNA (antisense) sequences for cancer molecules. Antisense or sense oligonucleotides, according to the present invention, comprise a fragment generally at least about 12 nucleotides, preferably from about 12 to 30 nucleotides. The ability to derive an antisense or a sense oligonucleotide, based upon a CDNA sequence encoding a given protein is described in, e.g., Stein &Cohen (Cancer Res. 48:2659 (1988 and van der Krol et al. (BioTechniques 6:958 (1988)).

Ribozymes

In addition to antisense polynucleotides, ribozymes can be used to target and inhibit transcription of cancer-associated nucleotide sequences. A ribozyme is an RNA molecule that catalytically cleaves other RNA molecules. Different kinds of ribozymes have been described, including group I ribozymes, hammerhead ribozymes, hairpin ribozymes, RNase P, and axhead ribozymes (see, e.g., Castanotto et al., Adv. in Pharmacology 25: 289-317 (1994) for a general review of the properties of different ribozymes).

The general features of hairpin ribozymes are described, e.g., in Hampel et al., Nucl. Acids Res. 18:299-304 (1990); European Patent Publication No. 0360257; U.S. Pat. No. 5,254,678. Methods of preparing are well known to those of skill in the art (see, e.g., WO 94/26877; Ojwang et al., Proc. Natl. Acad. Sci. USA 90:6340-6344 (1993); Yamada et al., Human Gene Therapy 1:39-45 (1994); Leavitt et al., Proc. Natl. Acad Sci. USA 92:699-703 (1995); Leavitt et al., Human Gene Therapy 5: 1151-120 (1994); and Yamada et al., Virology 205: 121-126 (1994)).

Use of Modulators in Phenotypic Screening

In one embodiment, a test compound is administered to a population of cancer cells, which have an associated cancer expression profile. By "administration" or "contacting" herein is meant that the modulator is added to the cells in such a manner as to allow the modulator to act upon the cell, whether by uptake and intracellular action, or by action at the cell surface. In some embodiments, a nucleic acid encoding a proteinaceous agent (i.e., a peptide) is put into a viral construct such as an adenoviral or retroviral construct, and added to the cell, such that expression of the peptide agent is accomplished, e.g., PCT US97/01019. Regulatable gene therapy systems can also be used. Once the modulator has been administered to the cells, the cells are washed if desired and are allowed to incubate under preferably physiological conditions for some period. The cells are then harvested and a new gene expression profile is generated. Thus, e.g., cancer tissue is screened for agents that modulate, e.g., induce or suppress, the cancer phenotype. A change in at least one gene, preferably many, of the expression profile indicates that the agent has an effect on cancer activity. Similarly, altering a biological function or a signaling pathway is indicative of modulator activity. By defining such a signature for the cancer phenotype, screens for new drugs that alter the phenotype are devised. With this approach, the drug target need not be known and need not be represented in the original gene/protein expression screening platform, nor does the level of transcript for the target protein need to change. The modulator inhibiting function will serve as a surrogate marker As outlined above, screens are done to assess genes or gene products. That is, having identified a particular differentially expressed gene as important in a particular state, screening of modulators of either the expression of the gene or the gene product itself is performed.

Use of Modulators to Affect Peptides of the Invention

Measurements of cancer polypeptide activity, or of the cancer phenotype are performed using a variety of assays. For example, the effects of modulators upon the function of a cancer polypeptide(s) are measured by examining parameters described above. A physiological change that affects activity is used to assess the influence of a test compound on the polypeptides of this invention. When the functional outcomes are determined using intact cells or animals, a variety of effects can be assesses such as, in the case of a cancer associated with solid tumors, tumor growth, tumor metastasis, neovascularization, hormone release, transcriptional changes to both known and uncharacterized genetic markers (e.g., by Northern blots), changes in cell metabolism such as cell growth or pH changes, and changes in intracellular second messengers such as cGNIP.

Methods of Identifying Characterizing Cancer-associated Sequences

Expression of various gene sequences is correlated with cancer. Accordingly, disorders based on mutant or variant cancer genes are determined. In one embodiment, the invention provides methods for identifying cells containing variant cancer genes, e.g., determining the presence of, all or part, the sequence of at least one endogenous cancer gene in a cell. This is accomplished using any number of sequencing techniques. The invention comprises methods of identifying the cancer genotype of an individual, e.g., determining all or part of the sequence of at least one gene of the invention in the individual. This is generally done in at least one tissue of the individual, e.g., a tissue set forth in Table I, and may include the evaluation of a number of tissues or different samples of the same tissue. The method may include comparing the sequence of the sequenced gene to a known cancer gene, i.e., a wild-type gene to determine the presence of family members, homologies, mutations or variants. The sequence of all or part of the gene can then be compared to the sequence of a known cancer gene to determine if any differences exist. This is done using any number of known homology programs, such as BLAST, Bestfit, etc. The presence of a difference in the sequence between the cancer gene of the patient and the known cancer gene correlates with a disease state or a propensity for a disease state, as outlined herein.

In a preferred embodiment, the cancer genes are used as probes to determine the number of copies of the cancer gene in the genome. The cancer genes are used as probes to determine the chromosomal localization of the cancer genes. Information such as chromosomal localization finds use in providing a diagnosis or prognosis in particular when chromosomal abnormalities such as translocations, and the like are identified in the cancer gene locus.

XIV.) Kits/Articles of Manufacture

For use in the diagnostic and therapeutic applications described herein, kits are also within the scope of the invention. Such kits can comprise a carrier, package or container that is compartmentalized to receive one or more containers such as vials, tubes, and the like, each of the container(s) comprising one of the separate elements to be used in the method. For example, the container(s) can comprise a probe that is or can be detectably labeled. Such probe can be an antibody or polynucleotide specific for a FIG. 2-*related* protein or a FIG. 2 gene or message, respectively. Where the method utilizes nucleic acid hybridization to detect the target nucleic acid, the kit can also have containers containing nucleotide(s) for amplification of the target nucleic acid sequence and/or a container comprising a reporter-means, such as a biotin-binding protein, such as avidin or streptavidin, bound to a reporter molecule, such as an enzymatic, florescent, or radioisotope label. The kit can include all or part of the amino acid sequences in FIG. 2 or FIG. 3 or analogs thereof, or a nucleic acid molecules that encodes such amino acid sequences.

The kit of the invention will typically comprise the container described above and one or more other containers comprising materials desirable from a commercial and user standpoint, including buffers, diluents, filters, needles, syringes; carrier, package, container, vial and/or tube labels listing contents and/or instructions for use, and package inserts with instructions for use.

A label can be present on the container to indicate that the composition is used for a specific therapy or non-therapeutic application, such as a diagnostic or laboratory application, and can also indicate directions for either in vivo or in vitro use, such as those described herein. Directions and or other information can also be included on an insert(s) or label(s) which is included with or on the kit.

The terms "kit" and "article of manufacture" can be used as synonyms.

In another embodiment of the invention, an article(s) of manufacture containing compositions, such as amino acid sequence(s), small molecule(s), nucleic acid sequence(s), and/or antibody(s), e.g., materials useful for the diagnosis, prognosis, prophylaxis and/or treatment of neoplasias of tissues such as those set forth in Table I is provided. The article of manufacture typically comprises at least one container and at least one label. Suitable containers include, for example, bottles, vials, syringes, and test tubes. The containers can be formed from a variety of materials such as glass or plastic. The container can hold amino acid sequence(s), small molecule(s), nucleic acid sequence(s), and/or antibody(s), in one embodiment the container holds a polynucleotide for use in examining the mRNA expression profile of a cell, together with reagents used for this purpose.

The container can alternatively hold a composition which is effective for treating, diagnosis, prognosing or prophylaxing a condition and can have a sterile access port (for example the container can be an intravenous solution bag or a vial having a stopper pierceable by a hypodermic injection needle). The active agents in the composition can be an antibody capable of specifically binding 98P4B6 and modulating the function of 98P4B6.

The label can be on or associated with the container. A label a can be on a container when letters, numbers or other characters forming the label are molded or etched into the container itself; a label can be associated with a container when it is present within a receptacle or carrier that also holds the container, e.g., as a package insert. The label can indicate that the composition is used for diagnosing, treating, prophylaxing or prognosing a condition, such as a neoplasia of a tissue set forth in Table I. The article of manufacture can further comprise a second container comprising a pharmaceutically-acceptable buffer, such as phosphate-buffered saline, Ringer's solution and/or dextrose solution. It can further include other materials desirable from a commercial and user standpoint, including other buffers, diluents, filters, stirrers, needles, syringes, and/or package inserts with indications and/or instructions for use.

EXAMPLES

Various aspects of the invention are further described and illustrated by way of the several examples that follow, none of which are intended to limit the scope of the invention.

Example 1

SSH-Generated Isolation of cDNA Fragment of the 98P4B6 Gene

To isolate genes that are over-expressed in prostate cancer we used the Suppression Subtractive Hybridization (SSH)

procedure using cDNA derived from prostate tissues. The 98P4B6 SSH cDNA sequence was derived from normal prostate minus LAPC-4AD prostate xenograft cDNAs. The 98P4B6 cDNA was identified as highly expressed in prostate cancer.

Materials and Methods

Human Tissues:

The patient cancer and normal tissues were purchased from different sources such as the NDRI (Philadelphia, Pa.). mRNA for some normal tissues were purchased from Clontech, Palo Alto, Calif.

RNA Isolation:

Tissues were homogenized in Trizol reagent (Life Technologies, Gibco BRL) using 10 ml/g tissue isolate total RNA. Poly A RNA was purified from total RNA using Qiagen's Oligotex mRNA Mini and Midi kits. Total and mRNA were quantified by spectrophotometric analysis (O.D. 260/280 nm) and analyzed by gel electrophoresis.

Oligonucleotides:

The following HPLC purified oligonucleotides were used.

```
DPNCDN (cDNA synthesis primer):
                                      (SEQ ID NO: 101)
5'TTTTGATCAAGCTT₃₀3'

Adaptor 1:
                                      (SEQ ID NO: 102)
5'CTAATACGACTCACTATAGGGCTCGAGCGGCCGCCCGGGCAG3'
                                      (SEQ ID NO: 103)
3'GGCCCGTCCTAG5'

Adaptor 2:
                                      (SEQ ID NO: 104)
5'GTAATACGACTCACTATAGGGCAGCGTGGTCGCGGCCGAG3'
                                      (SEQ ID NO: 105)
3'CGGCTCCTAG5'

PCR primer 1:
                                      (SEQ ID NO: 106)
5'CTAATACGACTCACTATAGGGC3'

Nested primer (NP)1:
                                      (SEQ ID NO: 107)
5'TCGAGCGGCCGCCCGGGCAGGA3'

Nested primer (NP)2:
                                      (SEQ ID NO: 108)
5'AGCGTGGTCGCGGCCGAGGA3'
```

Suppression Subtractive Hybridization:

Suppression Subtractive Hybridization (SSH) was used to identify cDNAs corresponding to genes that may be differentially expressed in prostate cancer. The SSH reaction utilized cDNA from prostate cancer xenograft and normal tissues.

The gene 98P4B6 sequence was derived from normal prostate tissue minus prostate cancer xenograft LAPC-4AD cDNA subtraction. The SSH DNA sequence (FIG. 1) was identified.

The cDNA derived from LAPC-4AD was used as the source of the "driver" cDNA, while the cDNA from normal prostate was used as the source of the "tester" cDNA. Double stranded cDNAs corresponding to tester and driver cDNAs were synthesized from 2 µg of poly(A), RNA isolated from the relevant tissue, as described above, using CLONTECH's PCR-Select cDNA Subtraction Kit and 1 ng of oligonucleotide DPNCDN as primer. First- and second-strand synthesis were carried out as described in the Kit's user manual protocol (CLONTECH Protocol No. PT1117-1, Catalog No. K1804-1). The resulting cDNA was digested with Dpn II for 3 hrs at 37° C. Digested cDNA was extracted with phenol/chloroform (1:1) and ethanol precipitated.

Driver cDNA was generated by combining in a 1:1 ratio Dpn II digested cDNA from the relevant tissue source (see above) with digested cDNAs derived from normal tissue.

Tester cDNA was generated by diluting 1 µl of Dpn II digested cDNA from the relevant tissue source (see above) (400 ng) in 5 µl of water. The diluted cDNA (2 µl, 160 ng) was then ligated to 2 µl of Adaptor 1 and Adaptor 2 (10 µM), in separate ligation reactions, in a total volume of 10 µl at 16° C. overnight, using 400 u of T4 DNA ligase (CLONTECH). Ligation was terminated with 1 µl of 0.2 M EDTA and heating at 72° C. for 5 min.

The first hybridization was performed by adding 1.5 1l (600 ng) of driver cDNA to each of two tubes containing 1.5 µl (20 ng) Adaptor 1- and Adaptor 2-ligated tester cDNA. In a final volume of 4 µl, the samples were overlaid with mineral oil, denatured in an MJ Research thermal cycler at 98° C. for 1.5 minutes, and then were allowed to hybridize for 8 hrs at 68° C. The two hybridizations were then mixed together with an additional 1 µl of fresh denatured driver cDNA and were allowed to hybridize overnight at 68° C. The second hybridization was then diluted in 200 µl of 20 mM Hepes, pH 8.3, 50 mM NaCl, 0.2 mM EDTA, heated at 70° C. for 7 min. and stored at −20° C.

PCR Amplification, Cloning and Sequencing of Gene Fragments Generated from SSH:

To amplify gene fragments resulting from SSH reactions, two PCR amplifications were performed. In the primary PCR reaction 1 µl of the diluted final hybridization mix was added to 1 µl of PCR primer 1 (10 µM), 0.5 µl dNTP mix (10 µM), 2.5 µl 10×reaction buffer (CLONTECH) and 0.5 µl 50×Advantage cDNA polymerase Mix (CLONTECH) in a final volume of 25 µl. PCR 1 was conducted using the following conditions: 75° C. for 5 min., 94° C. for 25 sec., then 27 cycles of 94° C. for 10 sec, 66° C. for 30 sec, 72° C. for 1.5 min. Five separate primary PCR reactions were performed for each experiment. The products were pooled and diluted 1:10 with water. For the secondary PCR reaction, 1 µl from the pooled and diluted primary PCR reaction was added to the same reaction mix as used for PCR 1, except that primers NP1 and NP2 (10 µM) were used instead of PCR primer 1. PCR 2 was performed using 10-12 cycles of 94° C. for 10 sec, 68° C. for 30 sec, and 72° C. for 1.5 minutes. The PCR products were analyzed using 2% agarose gel electrophoresis.

The PCR products were inserted into pCR2.1 using the T/A vector cloning kit (Invitrogen). Transformed E. coli were subjected to blue/white and ampicillin selection. White colonies were picked and arrayed into 96 well plates and were grown in liquid culture overnight. To identify inserts, PCR amplification was performed on 1 ul of bacterial culture using the conditions of PCR1 and NP1 and NP2 as primers. PCR products were analyzed using 2% agarose gel electrophoresis.

Bacterial clones were stored in 20% glycerol in a 96 well format. Plasmid DNA was prepared, sequenced, and subjected to nucleic acid homology searches of the GenBank, dBest, and NCI-CGAP databases.

RT-PCR Expression Analysis:

First strand cDNAs can be generated from 1 µg of mRNA with oligo (dT)12-18 priming using the Gibco-BRL Superscript Preamplification system. The manufacturer's protocol was used which included an incubation for 50 min at 42° C. with reverse transcriptase followed by RNAse H treatment at 37° C. for 20 min. After completing the reaction, the volume can be increased to 200 µl with water prior to normalization.

First strand cDNAs from 16 different normal human tissues can be obtained from Clontech.

Normalization of the first strand cDNAs from multiple tissues was performed by using the primers 5'atatcgc-cgcgctcgtcgtcgacaa3' (SEQ ID NO: 109) and 5'agccacacg-cagctcattgtagaagg 3' (SEQ ID NO: 110) to amplify β-actin. First strand cDNA (5 µl) were amplified in a total volume of 50 µl containing 0.4 µM primers, 0.2 µM each dNTPs, 1×PCR buffer (Clontech, 10 mM Tris-HCl$_2$, 1.5 mM MgCl$_2$, 50 mM KCl, pH8.3) and 1X Klentaq DNA polymerase (Clontech). Five µl of the PCR reaction can be removed at 18, 20, and 22 cycles and used for agarose gel electrophoresis. PCR was performed using an MJ Research thermal cycler under the following conditions: Initial denaturation can be at 94° C. for 15 sec, followed by a 18, 20, and 22 cycles of 94° C. for 15, 65° C. for 2 min, 72° C. for 5 sec. A final extension at 72° C. was carried out for 2 min. After agarose gel electrophoresis, the band intensities of the 283 bp β-actin bands from multiple tissues were compared by visual inspection. Dilution factors for the first strand cDNAs were calculated to result in equal β-actin band intensities in all tissues after 22 cycles of PCR. Three rounds of normalization can be required to achieve equal band intensities in all tissues after 22 cycles of PCR.

To determine expression levels of the 98P4B6 gene, 5 µl of normalized first strand cDNA were analyzed by PCR using 26, and 30 cycles of amplification. Semi-quantitative expression analysis can be achieved by comparing the PCR products at cycle numbers that give light band intensities. The primers used for RT-PCR were designed using the 98P4B6 SSH sequence and are listed below:

```
98P4B6.1
5'-GACTGAGCTGGAACTGGAATTTGT-3'    (SEQ ID NO: 111)

98P4B6.2
5'-TTTGAGGAGACTTCATCTCACTGG-3'    (SEQ ID NO: 112)
```

Example 2

Isolation of Full Length 98P4B6 Encoding cDNA

The 98P4B6 SSH cDNA sequence was derived from a substracton consisting of normal prostate minus prostate cancer xenograft. The SSH cDNA sequence (FIG. 1) was designated 98P4B6.

The 98P4B6 SSH DNA sequence of 183 bp is shown in FIG. 1. Full-length 98P4B6 v.1 (clone GTD3) of 2453 bp was cloned from prostate cDNA library, revealing an ORF of 454 amino acids (FIG. 2 and FIG. 3). 98P4B6 v.6 was also cloned from normal prostate library. Other variants of 98P4B6 were also identified and these are listed in FIGS. 2 and 3.

98P4B6 v.2, v.3, v.4, v.5, v.6, v.7 and v.8 are splice variants of 98P4B6 v.1. 98P4B6 v.9 through v.19 are SNP variants and differ from v.1 by one amino acid. 98P4B6 v.20 through v.24 are SNP variants of v.7. 98P4B6 v.25 through v.38 are SNP variants of v.8. Though these SNP variants were shown separately, they could also occur in any combinations and in any transcript variants.

Example 3

Chromosomal Mapping of 98P4B6

Chromosomal localization can implicate genes in disease pathogenesis. Several chromosome mapping approaches are available including fluorescent in situ hybridization (FISH), human/hamster radiation hybrid (RH) panels (Walter et al., 1994; Nature Genetics 7:22; Research Genetics, Huntsville Ala.), human-rodent somatic cell hybrid panels such as is available from the Cornell Institute (Camden, N.J.), and genomic viewers utilizing BLAST homologies to sequenced and mapped genomic clones (NCBI, Bethesda, Md.).

98P4B6 maps to chromosome 7q21 using 98P4B6 sequence and the NCBI BLAST tool.

Example 4

Expression Analysis of 98P4B6

Expression analysis by RT-PCR demonstrated that 98P4B6 is strongly expressed in prostate cancer patient specimens (FIG. 14). First strand cDNA was generated from normal stomach, normal brain, normal heart, normal liver, normal skeletal muscle, normal testis, normal prostate, normal bladder, normal kidney, normal colon, normal lung, normal pancreas, and a pool of cancer specimens from prostate cancer patients, bladder cancer patients, kidney cancer patients, colon cancer patients, lung cancer patients, pancreas cancer patients, and a pool of 2 patient prostate metastasis to lymph node. Normalization was performed by PCR using primers to actin. Semi-quantitative PCR, using primers directed to 98P4B6 v.1, v.13, or/and v.14 (A), or directed specifically to the splice variants 98P4B6 v.6 and v.8 (B), was performed at 26 and 30 cycles of amplification. Samples were run on an agarose gel, and PCR products were quantitated using the Alphalmager software. Results show strong expression of 98P4B6 and its splice variants v.6 and v.8 in normal prostate and in prostate cancer. Expression was also detected in bladder cancer, kidney cancer, colon cancer, lung cancer, pancreas cancer, breast cancer, cancer metastasis as well as in the prostate cancer metastasis to lymph node specimens, compared to all normal tissues tested. As noted below, e.g., in Example 6, as 98P4B6 v. 1 is in expressed in cancer tissues such as those listed in Table 1, the other protein-encoding 98P4B6 variants are expressed in these tissues as well; this principle is corroborated by data in (FIG. 14) for the proteins herein designated 98P4B6 v.6 or v.8 is found, e.g., in prostate, lung, ovary, bladder, breast, colon, kidney and pancreas, cancers, as well as in the literature (Porkka et al., Lab Invest, 2002 and Korkmaz et al., JBC, 2002) where the protein 98P4B6 v.8 is identified in normal prostate and prostate cancer.

When the genomic region to which a gene maps is modulated in a particular cancer, the alternative transcripts or splice variants of the gene are modulated as well. Disclosed herein is that 98P4B6 has a particular expression profile related to cancer. Alternative transcripts and splice variants of 98P4B6 are also involved in cancers in the same or additional tissues, thus serving as tumor-associated markers/antigens.

Expression of 98P4B6 v.1, v.13, and/or v.14 was detected in prostate, lung, ovary, bladder, cervix, uterus and pancreas cancer patient specimens (FIG. 15). First strand cDNA was prepared from a panel of patient cancer specimens. Normalization was performed by PCR using primers to actin. Semi-quantitative PCR, using primers to 98P4B6, was performed at 26 and 30 cycles of amplification. Samples were run on an agarose gel, and PCR products were quantitated using the Alphalmager software. Expression was recorded as absent, low, medium or strong. Results show expression of 98P4B6 in the majority of all patient cancer specimens tested.

FIG. 16 shows that 98P4B6 is expressed in stomach cancer patient specimens. (A) RNA was extracted from normal stomach (N) and from 10 different stomach cancer patient specimens (T). Northern blot with 10 µg of total RNA/lane was probed with 98P4B6 sequence. Results show strong expression of 98P4B6 in the stomach tumor tissues and lower expression in normal stomach. The lower panel represents ethidium bromide staining of the blot showing quality of the RNA samples. (B) Expression of 98P4B6 was assayed in a panel of human stomach cancers (T) and their respective matched normal tissues (N) on RNA dot blots. 98P4B6 was detected in 7 out of 8 stomach tumors but not in the matched normal tissues.

Example 5

Transcript Variants of 98P4B6

Transcript variants are variants of mature mRNA from the same gene which arise by alternative transcription or alternative splicing. Alternative transcripts are transcripts from the same gene but start transcription at different points. Splice variants are mRNA variants spliced differently from the same transcript. In eukaryotes, when a multi-exon gene is transcribed from genomic DNA, the initial RNA is spliced to produce functional mRNA, which has only exons and is used for translation into an amino acid sequence. Accordingly, a given gene can have zero to many alternative transcripts and each transcript can have zero to many splice variants. Each transcript variant has a unique exon makeup, and can have different coding and/or non-coding (5' or 3' end) portions, from the original transcript. Transcript variants can code for similar or different proteins with the same or a similar function or can encode proteins with different functions, and can be expressed in the same tissue at the same time or in different tissues at the same time or in the same tissue at different times or in different tissues at different times. Proteins encoded by transcript variants can have similar or different cellular or extracellular localizations, e.g., secreted versus intracellular.

Transcript variants are identified by a variety of art-accepted methods. For example, alternative transcripts and splice variants are identified by full-length cloning experiment, or by use of full-length transcript and EST sequences. First, all human ESTs were grouped into clusters which show direct or indirect identity with each other. Second, ESTs in the same cluster were further grouped into sub-clusters and assembled into a consensus sequence. The original gene sequence is compared to the consensus sequence(s) or other full-length sequences. Each consensus sequence is a potential splice variant for that gene. Even when a variant is identified that is not a full-length clone, that portion of the variant is very useful for antigen generation and for further cloning of the full-length splice variant, using techniques known in the art.

Moreover, computer programs are available in the art that identify transcript variants based on genomic sequences. Genomic-based transcript variant identification programs include FgenesH (A. Salamov and V. Solovyev, "Ab initio gene finding in Drosophila genomic DNA," Genome Research. 2000 April; 10(4):516-22); Grail and GenScan. For a general discussion of splice variant identification protocols see., e.g., Southan, C., A genomic perspective on human proteases, FEBS Lett. 2001 Jun. 8; 498(2-3):214-8; de Souza, S. J., et al., Identification of human chromosome 22 transcribed sequences with ORF expressed sequence tags, Proc. Natl Acad Sci USA. 2000 Nov. 7; 97(23):12690-3.

To further confirm the parameters of a transcript variant, a variety of techniques are available in the art, such as full-length cloning, proteomic validation, PCR-based validation, and 5' RACE validation, etc. (see e.g., Proteomic Validation: Brennan, S. O., et al., Albumin banks peninsula: a new termination variant characterized by electrospray mass spectrometry, Biochem Biophys Acta. 1999 Aug. 17;1433(1-2): 321-6; Ferranti P, et al., Differential splicing of pre-messenger RNA produces multiple forms of mature caprine alpha(s1)-casein, Eur J Biochem. 1997 Oct. 1;249(1):1-7. For PCR-based Validation: Wellmann S, et al., Specific reverse transcription-PCR quantification of vascular endothelial growth factor (VEGF) splice variants by LightCycler technology, Clin Chem. 2001 April;47(4):654-60; Jia, H. P., et al., Discovery of new human beta-defensins using a genomics-based approach, Gene. 2001 Jan. 24; 263(1-2):211-8. For PCR-based and 5' RACE Validation: Brigle, K. E., et al., Organization of the murine reduced folate carrier gene and identification of variant splice forms, Biochem Biophys Acta. 1997 Aug. 7; 1353(2): 191-8).

It is known in the art that genomic regions are modulated in cancers. Recently, Porkka et al. (2002) reported that transcript variants of STEAP2 were expressed and were found in both normal and malignant prostate tissue (Porkka, K. P., et al. Cloning and characterization of a novel six-transmembrane protein STEAP2, expressed in normal and malignant prostate. Laboratory Investigation 2002 November; 82(11):1573-1582). Another group of scientists also reported that transcript variants of STEAP2 (98P4B6 v.6 herein) also were expressed significantly higher in prostate cancer than normal prostate (Korkmaz, K. S., et al. Molecular cloning and characterization of STAMP1, a highly prostate-specific six transmembrane protein that is overexpressed in prostate cancer. The Journal of Biological Chemistry. 2002 September 277 (39):36689-36696.). When the genomic region to which a gene maps is modulated in a particular cancer, the alternative transcripts or splice variants of the gene are modulated as well. Disclosed herein is that 98P4B6 has a particular expression profile related to cancer. Alternative transcripts and splice variants of 98P4B6 are also involved in cancers in the same or additional tissues, thus serving as tumor-associated markers/antigens.

Using the full-length gene and EST sequences, seven transcript variants were identified, designated as 98P4B6 v.2, v.3, v.4, v.5, v.6, v.7 and v.8, as shown in FIG. 12. The boundaries of exons in the original transcript, 98P4B6 v.1 were shown in Table LI. The first 22 bases of v.1 were not in the nearby 5' region of v.1 on the current assembly of the human genome. Compared with 98P4B6 v.1, variant v.2 was a single exon transcript whose 3' portion was the same as the last exon of v.1. The first two exons of v.3 were in intron 1 of v. 1. Variants v.4, v.5, and v.6 spliced out 224-334 in the first exon of v.1. In addition, v.5 spliced out exon 5 while v.6 spliced out exon 6 but extended exon 5 of v.1. Variant v.7 used alternative transcription start and different 3' exons. Variant v.8 extended 5' end and kept the whole intron 5 of v.1. Theoretically, each different combination of exons in spatial order, e.g. exons 2 and 3, is a potential splice variant.

Tables LII through LV are set forth on a variant-by-variant basis. Tables LII(a)-(g) show the nucleotide sequence of the transcript variant. Tables LII (a)-(g) show the alignment of the transcript variant with the nucleic acid sequence of 98P4B6 v.1. Tables LIV(a)-(g) lay out the amino acid translation of the transcript variant for the identified reading frame orientation. Tables LV(a)-(g) display alignments of the amino acid sequence encoded by the splice variant with that of 98P4B6 v.1. Additionally, single nucleotide polymorphisms (SNP) are noted in the alignment.

Example 6

Single Nucleotide Polymorphisms of 98P4B6

A Single Nucleotide Polymorphism (SNP) is a single base pair variation in a nucleotide sequence at a specific location. At any given point of the genome, there are four possible nucleotide base pairs: A/T, C/G, G/C and T/A. Genotype refers to the specific base pair sequence of one or more locations in the genome of an individual. Haplotype refers to the base pair sequence of more than one location on the same DNA molecule (or the same chromosome in higher organisms), often in the context of one gene or in the context of several tightly linked genes. SNP that occurs on a cDNA is called cSNP. This cSNP may change amino acids of the protein encoded by the gene and thus change the functions of the protein. Some SNP cause inherited diseases; others contribute to quantitative variations in phenotype and reactions to environmental factors including diet and drugs among individuals. Therefore, SNP and/or combinations of alleles (called haplotypes) have many applications, including diagnosis of inherited diseases, determination of drug reactions and dosage, identification of genes responsible for diseases, and analysis of the genetic relationship between individuals (P. Nowotny, J. M. Kwon and A. M. Goate, a "SNP analysis to dissect human traits," Curr. Opin. Neurobiol. 2001 October; 11 (5):637-641; M. Pirmohamed and B. K. Park, "Genetic susceptibility to adverse drug reactions," Trends Pharmacol. Sci. 2001 June; 22(6):298-305; J. H. Riley, C. J. Allan, E. Lai and A. Roses, "The use of single nucleotide polymorphisms in the isolation of common disease genes," Pharmacogenomics. 2000 February; 1(1):3947; R. Judson, J. C. Stephens and A. Windemuth, "The predictive power of haplotypes in clinical response," Pharmacogenomics. 2000 February; 1(1):15-26).

SNP are identified by a variety of art-accepted methods (P. Bean, "The promising voyage of SNP target discovery," Am. Clin. Lab. 2001 October-November; 20(9):18-20; K. M. Weiss, "In search of human variation," Genome Res. 1998 July; 8(7):691-697; M. M. She, "Enabling large-scale pharmacogenetic studies by high-throughput mutation detection and genotyping technologies," Clin. Chem. 2001 Feb; 47(2):164-172). For example, SNP can be identified by sequencing DNA fragments that show polymorphism by gel-based methods such as restriction fragment length polymorphism (RFLP) and denaturing gradient gel electrophoresis (DGGE). They can also be discovered by direct sequencing of DNA samples pooled from different individuals or by comparing sequences from different DNA samples. With the rapid accumulation of sequence data in public and private databases, one can discover SNP by comparing sequences using computer programs (Z. Gu, L. Hillier and P. Y. Kwok, "Single nucleotide polymorphism hunting in cyberspace," Hum. Mutat. 1998; 12(4):221-225). SNP can be verified and genotype or haplotype of an individual can be determined by a variety of methods including direct sequencing and high throughput microarrays (P. Y. Kwok, "Methods for genotyping single nucleotide polymorphisms," Annu. Rev. Genomics Hum. Genet. 2001; 2:235-258; M. Kokoris, K. Dix, K. Moynihan, J. Mathis, B. Erwin, P. Grass, B. Hines and A. Duesterhoeft, "High-throughput SNP genotyping with the Masscode system," Mol. Diagn. 2000 December; 5(4):329-340).

Using the methods described above, eleven SNP were identified in the original transcript, 98P4B6 v.1, at positions 46 (A/G), 179 (CfT), 180 (A/G), 269 (A/G), 404 (GIT), 985 (CIT), 1170 (T/C), 1497 (ANG), 1746 (T/G), 2046 (T/G) and 2103 (T/C). The transcripts or proteins with alternative allele were designated as variant 98P4B6 v.9 through v. 19, as shown in FIG. 10a. FIG. 11 shows the schematic alignment of protein variants, corresponding to nucleotide variants. Nucleotide variants that code for the same amino acid sequence as v.1 are not shown in FIG. 11. These alleles of the SNP, though shown separately here, can occur in different combinations (haplotypes) and in any one of the transcript variants (such as 98P4B6 v.5) that contains the site of the SNP. In addition, there were SNP in other transcript variants in regions not shared with v.1. For example, there were fourteen SNP in the fifth intron of v.1, which was part of transcript variants v.2, v.6 and v.8. These SNP are shown in FIG. 10c and listed as following (numbers relative v.8): 1760 (G/A), 1818 (GIT), 1870 (CIT), 2612 (T/C), 2926 (T/A), 4241 (T/A), 4337 (AIG), 4338 (A/C), 4501 (A/G), 4506 (CIT), 5434 (C/A), 5434 (C/G), 5434 (CIT) and 5589 (C/A). FIG. 1Ob shows the SNP in the unique regions of transcript variant v.7: 1956 (A/C), 1987 (T/A), 2010 (G/C), 2010 (G/T) and 2059 (G/A) (numbers correspond to nucleotide sequence of v.7).

Example 7

Production of Recombinant 98P4B6 in Prokaryotic Systems

To express recombinant 98P4B6 and 98P4B6 variants in prokaryotic cells, the full or partial length 98P4B6 and 98P4B6 variant cDNA sequences are cloned into any one of a variety of expression vectors known in the art. One or more of the following regions of 98P4B6 variants are expressed: the full length sequence presented in FIGS. 2 and 3, or any 8, 9, 10, 11, 12, 13, 14, 15, 16, 17, 18, 19, 20, 21, 22, 23, 24, 25, 26, 27, 28, 29, 30 or more contiguous amino acids from 98P4B6, variants, or analogs thereof.

A. In vitro Transcription and Translation Constructs:

pCRII: To generate 98P4B6 sense and anti-sense RNA probes for RNA in situ investigations, pCRII constructs (Invitrogen, Carlsbad Calif.) are generated encoding either all or fragments of the 98P4B6 cDNA. The pCRII vector has Sp6 and T7 promoters flanking the insert to drive the transcription of 98P4B6 RNA for use as probes in RNA in situ hybridization experiments. These probes are used to analyze the cell and tissue expression of 98P4B6 at the RNA level. Transcribed 98P4B6 RNA representing the cDNA amino acid coding region of the 98P4B6 gene is used in in vitro translation systems such as the TnT™ Coupled Reticulolysate System (Promega, Corp., Madison, Wis.) to synthesize 98P4B6 protein.

B. Bacterial Constructs:

PGEX Constructs: To generate recombinant 98P4B6 proteins in bacteria that are fused to the Glutathione S-transferase (GST) protein, all or parts of the 98P4B6 cDNA protein coding sequence are cloned into the pGEX family of GST-fusion vectors (Amersham Pharmacia Biotech, Piscataway, N.J.). These constructs allow controlled expression of recombinant 98P4B6 protein sequences with GST fused at the amino-terminus and a six histidine epitope (6×His) at the carboxyl-terminus. The GST and 6×His tags permit purification of the recombinant fusion protein from induced bacteria with the appropriate affinity matrix and allow recognition of the fusion protein with anti-GST and anti-His antibodies. The 6×His tag is generated by adding 6 histidine codons to the cloning primer at the 3' end, e.g., of the open reading frame (ORF). A proteolytic cleavage site, such as the PreScission™ recognition site in pGEX-6P-1, may be employed such that it permits cleavage of the GST tag from 98P4B6-related protein. The ampicillin resistance gene and pBR322 origin permits selection and maintenance of the pGEX plasmids in *E. coli*. A glutathione-S-transferase (GST) fusion protein encompassing amino acids 2-204 of the STEAP-2 protein sequence was generated in the pGEX vector. The recombinant GST-STEAP-2 fusion protein was purified from induced bacteria by glutathione-sepaharose affinity chromatography and used as immunogen for generation of a polyclonal antibody.

pMAL Constructs: To generate, in bacteria, recombinant 98P4B6 proteins that are fused to maltose-binding protein (MBP), all or parts of the 98P4B6 cDNA protein coding sequence are fused to the MBP gene by cloning into the pMAL-c2× and pMAL-p2×vectors (New England Biolabs, Beverly, Mass.). These constructs allow controlled expression of recombinant 98P4B6 protein sequences with MBP fused at the amino-terminus and a 6×His epitope tag at the carboxyl-terminus. The MBP and 6×His tags permit purification of the recombinant protein from induced bacteria with the appropriate affinity matrix and allow recognition of the fusion protein with anti-MBP and anti-His antibodies. The 6×His epitope tag is generated by adding 6 histidine codons to the 3' cloning primer. A Factor Xa recognition site permits cleavage of the pMAL tag from 98P4B6. The pMAL-c2× and pMAL-p2×vectors are optimized to express the recombinant protein in the cytoplasm or periplasm respectively. Periplasm expression enhances folding of proteins with disulfide bonds.

pET Constructs: To express 98P4B6 in bacterial cells, all or parts of the 98P4B6 cDNA protein coding sequence are cloned into the pET family of vectors (Novagen, Madison, Wis.). These vectors allow tightly controlled expression of recombinant 98P4B6 protein in bacteria with and without fusion to proteins that enhance solubility, such as NusA and thioredoxin (Trx), and epitope tags, such as 6×His and S-Tag™ that aid purification and detection of the recombinant protein. For example, constructs are made utilizing pET NusA fusion system 43.1 such that regions of the 98P4B6 protein are expressed as amino-terminal fusions to NusA.

C. Yeast Constructs:

pESC Constructs: To express 98P4B6 in the yeast species *Saccharomyces cerevisiae* for generation of recombinant protein and functional studies, all or parts of the 98P4B6 cDNA protein coding sequence are cloned into the pESC family of vectors each of which contain 1 of 4 selectable markers, HIS3, TRP1, LEU2, and URA3 (Stratagene, La Jolla, Calif.). These vectors allow controlled expression from the same plasmid of up to 2 different genes or cloned sequences containing either Flag™ or Myc epitope tags in the same yeast cell. This system is useful to confirm protein-protein interactions of 98P4B6. In addition, expression in yeast yields similar post-translational modifications, such as glycosylations and phosphorylations, that are found when expressed in eukaryotic cells.

pESP Constructs: To express 98P4B6 in the yeast species *Saccharomyces pombe*, all or parts of the 98P4B6 cDNA protein coding sequence are cloned into the pESP family of vectors. These vectors allow controlled high level of expression of a 98P4B6 protein sequence that is fused at either the amino terminus or at the carboxyl terminus to GST which aids purification of the recombinant protein. A Flag™ epitope tag allows detection of the recombinant protein with anti-Flag™ antibody.

Example 8

Production of Recombinant 98P4B6 in Higher Eukaryotic Systems

A. Mammalian Constructs:

To express recombinant 98P4B6 in eukaryotic cells, the full or partial length 98P4B6 cDNA sequences can be cloned into any one of a variety of expression vectors known in the art. One or more of the following regions of 98P4B6 are expressed in these constructs, amino acids 1 to 255, or any 8, 9, 10, 11, 12, 13, 14, 15, 16, 17, 18, 19, 20, 21, 22, 23, 24, 25, 26, 27, 28, 29, 30 or more contiguous amino acids from 98P4B6 v.1 through v.11; amino acids 1 to 1266, or any 8, 9, 10, 11, 12, 13, 14, 15, 16, 17, 18, 19, 20, 21, 22, 23, 24, 25, 26, 27, 28, 29, 30 or more contiguous amino acids from 98P4B6 v.12 and v.13, variants, or analogs thereof.

The constructs can be transfected into any one of a wide variety of mammalian cells such as 293T cells. Transfected 293T cell lysates can be probed with the anti-98P4B6 polyclonal serum, described herein.

pcDNA4/HisMax Constructs: To express 98P4B6 in mammalian cells, a 98P4B6 ORF, or portions thereof, of 98P4B6 are cloned into pcDNA4/HisMax Version A (Invitrogen, Carlsbad, Calif.). Protein expression is driven from the cytomegalovirus (CMV) promoter and the SP16 translational enhancer. The recombinant protein has Xpress™ and six histidine (6×His) epitopes fused to the amino-terminus. The pcDNA4/HisMax vector also contains the bovine growth hormone (BGH) polyadenylation signal and transcription termination sequence to enhance mRNA stability along with the SV40 origin for episomal replication and simple vector rescue in cell lines expressing the large T antigen. The Zeocin resistance gene allows for selection of mammalian cells expressing the protein and the ampicillin resistance gene and ColE1 origin permits selection and maintenance of the plasmid in *E. coli*.

pcDNA3.1/MycHis Constructs: To express 98P4B6 in mammalian cells, a 98P4B6 ORF, or portions thereof, of 98P4B6 with a consensus Kozak translation initiation site was cloned into pcDNA3.1/MycHis Version A (Invitrogen, Carlsbad, Calif.). Protein expression is driven from the cytomegalovirus (CMV) promoter. The recombinant proteins have the myc epitope and 6×His epitope fused to the carboxyl-terminus. The pcDNA3.1/MycHis vector also contains the bovine growth hormone (BGH) polyadenylation signal and transcription termination sequence to enhance mRNA stability, along with the SV40 origin for episomal replication and simple vector rescue in cell lines expressing the large T antigen. The Neomycin resistance gene can be used, as it allows for selection of mammalian cells expressing the protein and the ampicillin resistance gene and ColE1 origin permits selection and maintenance of the plasmid in *E. coli*.

pcDNA3.1/GFP Construct: To express 98P4B6 in mammalian cells and to allow detection of the recombinant proteins using fluorescence, the 98P4B6 ORF sequence was codon optimized according to Mirzabekov et al. (1999), and was cloned into pcDNA3.1/GFP vector to generate 98P4B6.GFP.pcDNA3.1 construct. Protein expression was driven from the cytomegalovirus (CMV) promoter. The recombinant protein had the Green Fluorescent Protein (GFP) fused to the carboxyl-terminus facilitating non-invasive, in vivo detection and cell biology studies. The pcDNA3.1/GFP vector also contains the bovine growth hormone (BGH) polyadenylation signal and transcription termination sequence to enhance mRNA stability along with the SV40 origin for episomal replication and simple vector rescue in cell lines expressing the large T antigen. The Neomycin resistance gene allows for selection of mammalian cells that express the protein, and the ampicillin resistance gene and ColE1 origin permits selection and maintenance of the plasmid in *E. coli.*

Transfection of 98P4B6.GFP.pcDNA3.1 into 293T cells was performed as shown in FIGS. 17 and 18. Results show strong expression of the fusion protein by western blot analysis (FIG. 17), flow cytometry (FIG. 18A) and fluorescent microscopy (FIG. 18B).

Additional constructs with an amino-terminal GFP fusion are made in pcDNA3.1/NT-GFP-TOPO spanning the entire length of a 98P4B6 protein.

PAPtag: A 98P4B6 ORF, or portions thereof, is cloned into pAPtag-5 (GenHunter Corp. Nashville, Tenn.). This construct generates an alkaline phosphatase fusion at the carboxyl-terminus of a 98P4B6 protein while fusing the IgGK signal sequence to the amino-terminus. Constructs are also generated in which alkaline phosphatase with an amino-terminal IgGκ signal sequence is fused to the amino-terminus of a 98P4B6 protein. The resulting recombinant 98P4B6 proteins are optimized for secretion into the media of transfected mammalian cells and can be used to identify proteins such as ligands or receptors that interact with 98P4B6 proteins. Protein expression is driven from the CMV promoter and the recombinant proteins also contain myc and 6xHis epitopes fused at the carboxyl-terminus that facilitates detection and purification. The Zeocin resistance gene present in the vector allows for selection of mammalian cells expressing the recombinant protein and the ampicillin resistance gene permits selection of the plasmid in *E coli.* pTa5: A 98P4B6 ORF, or portions thereof, is cloned into pTag-5. This vector is similar to pAPtag but without the alkaline phosphatase fusion. This construct generates 98P4B6 protein with an amino-terminal IgGK signal sequence and myc and 6xHis epitope tags at the carboxyl-terminus that facilitate detection and affinity purification. The resulting recombinant 98P4B6 protein is optimized for secretion into the media of transfected mammalian cells, and is used as immunogen or ligand to identify proteins such as ligands or receptors that interact with the 98P4B6 proteins. Protein expression is driven from the CMV promoter. The Zeocin resistance gene present in the vector allows for selection of mammalian cells expressing the protein, and the ampicillin resistance gene permits selection of the plasmid in *E. coli.*

PsecFc: A 98P4B6 ORF, or portions thereof, is also cloned into psecFc. The psecFc vector was assembled by cloning the human immunoglobulin G1 (IgG) Fc (hinge, CH2, CH3 regions) into pSecTag2 (Invitrogen, California). This construct generates an IgG1 Fc fusion at the carboxyl-terminus of the 98P4B6 proteins, while fusing the IgGK signal sequence to N-terminus. 98P4B6 fusions utilizing the murine IgG1 Fc region are also used. The resulting recombinant 98P4B6 proteins are optimized for secretion into the media of transfected mammalian cells, and can be used as immunogens or to identify proteins such as ligands or receptors that interact with 98P4B6 protein. Protein expression is driven from the CMV promoter. The hygromycin resistance gene present in the vector allows for selection of mammalian cells that express the recombinant protein, and the ampicillin resistance gene permits selection of the plasmid in *E. coli.*

DSRα Constructs: To generate mammalian cell lines that express 98P4B6 constitutively, 98P4B6 ORF, or portions thereof, of 98P4B6 were cloned into pSRα constructs. Amphotropic and ecotropic retroviruses were generated by transfection of pSRα constructs into the 293T-1 OA1 packaging line or co-transfection of pSRα and a helper plasmid (containing deleted packaging sequences) into the 293 cells, respectively. The retrovirus is used to infect a variety of mammalian cell lines, resulting in the integration of the cloned gene, 98P4B6, into the host cell-lines. Protein expression is driven from a long terminal repeat (LTR). The Neomycin resistance gene present in the vector allows for selection of mammalian cells that express the protein, and the ampicillin resistance gene and ColE1 origin permit selection and maintenance of the plasmid in *E. coli*. The retroviral vectors can thereafter be used for infection and generation of various cell lines using, for example, PC3, NIH 3T3, TsuPr1, 293 or rat-1 cells.

Additional pSRα constructs are made that fuse an epitope tag such as the FLAG™ tag to the carboxyl-terminus of 98P4B6 sequences to allow detection using anti-Flag antibodies. For example, the FLAG™ sequence 5' gat tac aag gat gac gac gat aag 3' (SEQ ID NO: 113) is added to cloning primer at the 3' end of the ORF. Additional pSRα constructs are made to produce both amino-terminal and carboxyl-terminal GFP and myc/6xHis fusion proteins of the full-length 98P4B6 proteins.

Additional Viral Vectors: Additional constructs are made for viral-mediated delivery and expression of 98P4B6. High virus titer leading to high level expression of 98P4B6 is achieved in viral delivery systems such as adenoviral vectors and herpes amplicon vectors. A 98P4B6 coding sequences or fragments thereof are amplified by PCR and subcloned into the AdEasy shuttle vector (Stratagene). Recombination and virus packaging are performed according to the manufacturer's instructions to generate adenoviral vectors. Alternatively, 98P4B6 coding sequences or fragments thereof are cloned into the HSV-1 vector (Imgenex) to generate herpes viral vectors. The viral vectors are thereafter used for infection of various cell lines such as PC3, NIH 3T3, 293 or rat-1 cells.

Regulated Expression Systems: To control expression of 98P4B6 in mammalian cells, coding sequences of 98P4B6, or portions thereof, are cloned into regulated mammalian expression systems such as the T-Rex System (Invitrogen), the GeneSwitch System (Invitrogen) and the tightly-regulated Ecdysone System (Sratagene). These systems allow the study of the temporal and concentration dependent effects of recombinant 98P4B6. These vectors are thereafter used to control expression of 98P4B6 in various cell lines such as PC3, NIH 3T3, 293 or rat-1 cells.

B. Baculovirus Expression Systems

To generate recombinant 98P4B6 proteins in a baculovirus expression system, 98P4B6 ORF, or portions thereof, are cloned into the baculovirus transfer vector pBlueBac 4.5 (Invitrogen), which provides a His-tag at the N-terminus. Specifically, pBlueBac-98P4B6 is co-transfected with helper plasmid pBac-N-Blue (Invitrogen) into SF9 (*Spodoptera frugiperda*) insect cells to generate recombinant baculovirus (see Invitrogen instruction manual for details). Baculovirus is then collected from cell supernatant and purified by plaque assay.

Recombinant 98P4B6 protein is then generated by infection of HighFive insect cells (Invitrogen) with purified baculovirus. Recombinant 98P4B6 protein can be detected using anti-98P4B6 or anti-His-tag antibody. 98P4B6 protein can be purified and used in various cell-based assays or as immunogen to generate polyclonal and monoclonal antibodies specific for 98P4B6.

Example 9

Antigenicity Profiles and Secondary Structure

FIG. 5(A-E), FIG. 6(A-E), FIG. 7(A-E), FIG. 8(A-E), and FIG. 9(A-E) depict graphically five amino acid profiles of 98P4B6 variants 1, 2, 5-7, each assessment available by accessing the ProtScale website located on the ExPasy molecular biology server.

These profiles: FIG. 5, Hydrophilicity, (Hopp T. P., Woods K. R., 1981. Proc. Natl. Acad. Sci. U.S.A. 78:3824-3828); FIG. 6, Hydropathicity, (Kyte J., Doolittle R. F., 1982. J. Mol. Biol. 157:105-132); FIG. 7, Percentage Accessible Residues (Janin J., 1979 Nature 277:491-492); FIG. 8, Average Flexibility, (Bhaskaran R., and Ponnuswamy P. K., 1988. Int. J. Pept. Protein Res. 32:242-255); FIG. 9, Beta-turn (Deleage, G., Roux B. 1987 Protein Engineering 1:289-294); and optionally others available in the art, such as on the ProtScale website, were used to identify antigenic regions of each of the 98P4B6 variant proteins. Each of the above amino acid profiles of 98P4B6 variants were generated using the following ProtScale parameters for analysis: 1) A window size of 9; 2) 100% weight of the window edges compared to the window center; and, 3) amino acid profile values normalized to lie between 0 and 1.

Hydrophilicity (FIG. 5), Hydropathicity (FIG. 6) and Percentage Accessible Residues (FIG. 7) profiles were used to determine stretches of hydrophilic amino acids (i.e., values greater than 0.5 on the Hydrophilicity and Percentage Accessible Residues profile, and values less than 0.5 on the Hydropathicity profile). Such regions are likely to be exposed to the aqueous environment, be present on the surface of the protein, and thus available for immune recognition, such as by antibodies.

Average Flexibility (FIG. 8) and Beta-turn (FIG. 9) profiles determine stretches of amino acids (i.e., values greater than 0.5 on the Beta-turn profile and the Average Flexibility profile) that are not constrained in secondary structures such as beta sheets and alpha helices. Such regions are also more likely to be exposed on the protein and thus accessible to immune recognition, such as by antibodies.

Antigenic sequences of the 98P4B6 variant proteins indicated, e.g., by the profiles set forth in FIG. 5(A-E), FIG. 6(A-E), FIG. 7(A-E), FIG. 8(A-E), and/or FIG. 9(A-E) are used to prepare immunogens, either peptides or nucleic acids that encode them, to generate therapeutic and diagnostic anti-98P4B6 antibodies. The immunogen can be any 5, 6, 7, 8, 9, 10, 11, 12, 13, 14, 15, 16, 17, 18, 19, 20, 21, 22, 23, 24, 25, 30, 35, 40, 45, 50 or more than 50 contiguous amino acids, or the corresponding nucleic acids that encode them, from the 98P4B6 protein variants 1, 2, 5-7 listed in FIGS. 2 and 3. In particular, peptide immunogens of the invention can comprise, a peptide region of at least 5 amino acids of FIGS. 2 and 3 in any whole number increment that includes an amino acid position having a value greater than 0.5 in the Hydrophilicity profiles of FIG. 5; a peptide region of at least 5 amino acids of FIGS. 2 and 3 in any whole number increment that includes an amino acid position having a value less than 0.5 in the Hydropathicity profile of FIGS. 6; a peptide region of at least 5 amino acids of FIGS. 2 and 3 in any whole number increment that includes an amino acid position having a value greater than 0.5 in the Percent Accessible Residues profiles of FIG. 7; a peptide region of at least 5 amino acids of FIGS. 2 and 3 in any whole number increment that includes an amino acid position having a value greater than 0.5 in the Average Flexibility profiles on FIG. 8 ; and, a peptide region of at least 5 amino acids of FIGS. 2 and 3 in any whole number increment that includes an amino acid position having a value greater than 0.5 in the Beta-turn profile of FIG. 9. Peptide immunogens of the invention can also comprise nucleic acids that encode any of the forgoing.

All immunogens of the invention, peptide or nucleic acid, can be embodied in human unit dose form, or comprised by a composition that includes a pharmaceutical excipient compatible with human physiology.

The secondary structure of 98P4B6 protein variants 1, 2, 5-7, namely the predicted presence and location of alpha helices, extended strands, and random coils, is predicted from the primary amino acid sequence using the HNN—Hierarchical Neural Network method, accessed from the ExPasy molecular biology server. The analysis indicates that 98P4B6 variant 1 is composed of 54.41% alpha helix, 12.33% extended strand, and 33.26% random coil (FIG. 13A). Variant 2 is composed of 17.78% alpha helix, 6.67% extended strand, and 75.56% random coil (FIG. 13B). Variant 5 is composed of 51.55% alpha helix, 13.13% extended strand, and 35.32% random coil (FIG. 13C). Variant 6 is composed of 54.49% alpha helix, 11.84% extended strand, and 33.67% random coil (FIG. 13D). Variant 7 is composed of 48.26% alpha helix, 15.28% extended strand, and 36.46% random coil (FIG. 13E).

Analysis for the potential presence of transmembrane domains in the 98P4B6 variant proteins was carried out using a variety of transmembrane prediction algorithms accessed from the ExPasy molecular biology server. Shown graphically in FIG. 13F and 13G are the results of analysis of variant 1 depicting the presence and location of 6 transmembrane domains using the TMpred program (FIG. 13F) and 5 transmembrane domains using the TMHMM program (FIG. 13G). Shown graphically in FIG. 13H and 13I are the results of analysis of variant 2 depicting the presence and location of 1 transmembrane domains using the TMpred program (FIG. 13H) and no transmembrane domains using the TMHMM program (FIG. 13I). Shown graphically in FIG. 13J and 13K are the results of analysis of variant 5 depicting the presence and location of 6 transmembrane domains using the TMpred program (FIG. 13J) and 4 transmembrane domains using the TMHMM program (FIG. 13K). Shown graphically in FIG. 13L and 13M are the results of analysis of variant 6 depicting the presence and location of 6 transmembrane domains using the TMpred program (FIG. 13L) and 6 transmembrane domains using the TMHMM program (FIG. 13M). Shown graphically in FIG. 13N and 13O are the results of analysis of variant 7 depicting the presence and location of 6 transmembrane domains using the TMpred program (FIG. 13N) and 4 transmembrane domains using the TMHMM program (FIG. 13O). The results of each program, namely the amino acids encoding the transmembrane domains are summarized in Table VI.

Example 10

Generation of 98P4B6 Polyclonal Antibodies

Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. In addition to immunizing with a full length 98P4B6 protein variant, computer algorithms are employed in design of immunogens that, based on amino acid sequence analysis contain characteristics of being antigenic and available for recognition by the immune system of the immunized host (see Example 9 entitled "Antigenicity Profiles and Secondary Structure"). Such regions would be predicted to be hydrophilic, flexible, in beta-turn conformations, and be exposed on the surface of the protein (see, e.g., FIG. 5(A-E), FIG. 6(A & B), FIG. 7(A-E), FIG. 8(A -E), or FIG. 9(A-E) for amino acid profiles that indicate such regions of 98P4B6 protein variants).

For example, recombinant bacterial fusion proteins or peptides containing hydrophilic, flexible, beta-turn regions of 98P4B6 protein variants are used as antigens to generate polyclonal antibodies in New Zealand White rabbits or monoclonal antibodies as described in Example 11. For example, in 98P4B6 variant 1, such regions include, but are not limited to, amino acids 153-165, amino acids 240-260, and amino acids 345-358. In sequence specific for variant 2, such regions include, but are not limited to, amino acids 26-38. In sequence specific for variant 5, such regions include, but are not limited to, amino acids 400-410. In sequence specific for variant 6, such regions include, but are not limited to, amino acids 455-490. In sequence specific for variant 7, such regions include, but are not limited to, amino acids 451-465 and amino acids 472-498. It is useful to conjugate the immunizing agent to a protein known to be immunogenic in the mammal being immunized. Examples of such immunogenic proteins include, but are not limited to, keyhole limpet hemocyanin (KLH), serum albumin, bovine thyroglobulin, and soybean trypsin inhibitor. In one embodiment, a peptide encoding amino acids 153-165 of 98P4B6 variant 1 was conjugated to KLH and used to immunize a rabbit. Alternatively the immunizing agent may include all or portions of the 98P4B6 variant proteins, analogs or fusion proteins thereof. For example, the 98P4B6 variant 1 amino acid sequence can be fused using recombinant DNA techniques to any one of a variety of fusion protein partners that are well known in the art, such as glutathione-S-transferase (GST) and HIS tagged fusion proteins. In another embodiment, amino acids 2-204 of 98P4B6 variant 1 was fused to GST using recombinant techniques and the pGEX expression vector, expressed, purified and used to immunize a rabbit. Such fusion proteins are purified from induced bacteria using the appropriate affinity matrix.

Other recombinant bacterial fusion proteins that may be employed include maltose binding protein, LacZ, thioredoxin, NusA, or an immunoglobulin constant region (see the section entitled "Production of 98P4B6 in Prokaryotic Systems" and Current Protocols In Molecular Biology, Volume 2, Unit 16, Frederick M. Ausubul et al. eds., 1995; Linsley, P. S., Brady, W., Umes, M., Grosmaire, L., Damle, N., and Ledbetter, L. (1991) J. Exp. Med. 174, 561-566).

In addition to bacterial derived fusion proteins, mammalian expressed protein antigens are also used. These antigens are expressed from mammalian expression vectors such as the Tag5 and Fc-fusion vectors (see the section entitled "Production of Recombinant 98P4B6 in Eukaryotic Systems"), and retain post-translational modifications such as glycosylations found in native protein. In one embodiment, amino acids 324-359 of variant 1, encoding an extracellular loop between transmembrane domains, is cloned into the Tag5 mammalian secretion vector. The recombinant protein is purified by metal chelate chromatography from tissue culture supernatants of 293T cells stably expressing the recombinant vector. The purified Tag5 98P4B6 protein is then used as immunogen.

During the immunization protocol, it is useful to mix or emulsify the antigen in adjuvants that enhance the immune response of the host animal. Examples of adjuvants include, but are not limited to, complete Freund's adjuvant (CFA) and MPL-TDM adjuvant (monophosphoryl Lipid A, synthetic trehalose dicorynomycolate).

In a typical protocol, rabbits are initially immunized subcutaneously with up to 200 µg, typically 100-200 µg, of fusion protein or peptide conjugated to KLH mixed in complete Freund's adjuvant (CFA). Rabbits are then injected subcutaneously every two weeks with up to 200 µg, typically 100-200 µg, of the immunogen in incomplete Freund's adjuvant (IFA). Test bleeds are taken approximately 7-10 days following each immunization and used to monitor the titer of the antiserum by ELISA.

To test reactivity and specificity of immune serum, such as the rabbit serum derived from immunization with the Tag5-98P4B6 variant 1 protein, the full-length 98P4B6 variant 1 cDNA is cloned into pCDNA 3.1 myc-his expression vector (Invitrogen, see the Example entitled "Production of Recombinant 98P4B6 in Eukaryotic Systems"). After transfection of the constructs into 293T cells, cell lysates are probed with the anti-98P4B6 serum and with anti-His antibody (Santa Cruz Biotechnologies, Santa Cruz, Calif.) to determine specific reactivity to denatured 98P4B6 protein using the Western blot technique. Detection of 98P4B6 variant 1 protein expressed in 293T with polyclonal antibodies raised to a GST-fusion protein and peptide is shown in FIGS. 17B and 17C, respectively. In addition, the immune serum is tested by fluorescence microscopy, flow cytometry and immunoprecipitation against 293T and other recombinant 98P4B6-expressing cells to determine specific recognition of native protein. Western blot, immunoprecipitation, fluorescent microscopy, and flow cytometric techniques using cells that endogenously express 98P4B6 are also carried out to test reactivity and specificity.

Anti-serum from rabbits immunized with 98P4B6 variant fusion proteins, such as GST and MBP fusion proteins, are purified by depletion of antibodies reactive to the fusion partner sequence by passage over an affinity column containing the fusion partner either alone or in the context of an irrelevant fusion protein. For example, antiserum derived from a GST-98P4B6 variant 1 fusion protein was first purified by passage over a column of GST protein covalently coupled to AffiGel matrix (BioRad, Hercules, Calif.). The antiserum is then affinity purified by passage over a column composed of a MBP-98P4B6 fusion protein covalently coupled to Affigel matrix. The serum is then further purified by protein G affinity chromatography to isolate the IgG fraction. Sera from other His-tagged antigens and peptide immunized rabbits as well as fusion partner depleted sera are affinity purified by passage over a column matrix composed of the original protein immunogen or free peptide, such as the anti-peptide polyclonal antibody used in FIG. 17C.

Example 11

Generation of 98P4B6 Monoclonal Antibodies (mAbs)

In one embodiment, therapeutic mAbs to 98P4B6 variants comprise those that react with epitopes specific for each variant protein or specific to sequences in common between the variants that would disrupt or modulate the biological function of the 98P4B6 variants, for example those that would disrupt the interaction with ligands and binding partners. Immunogens for generation of such mAbs include those designed to encode or contain the entire 98P4B6 protein variant sequence, regions of the 98P4B6 protein variants predicted to be antigenic from computer analysis of the amino acid sequence (see, e.g., FIG. 5(A-E), FIG. 6(A-E), FIG. 7(A-E), FIG. 8(A-E), or FIG. 9(A-E), and Example 9 entitled "Antigenicity Profiles and Secondary Structure"). Immunogens include peptides, recombinant bacterial proteins, and mammalian expressed Tag 5 proteins and human and murine IgG FC fusion proteins. In addition, cells engineered to express high levels of a respective 98P4B6 variant, such as 293T-98P4B6 variant 1 or 300.19-98P4B6 variant 1murine Pre-B cells, are used to immunize mice.

To generate mAbs to a 98P4B6 variant, mice are first immunized intraperitoneally (IP) with, typically, 10-50 µg of protein immunogen or $10^7$ 98P4B6-expressing cells mixed in complete Freund's adjuvant. Mice are then subsequently immunized IP every 2-4 weeks with, typically, 10-50 µg of protein immunogen or $10^7$ cells mixed in incomplete Freund's adjuvant. Alternatively, MPL-TDM adjuvant is used in immunizations. In addition to the above protein and cell-based immunization strategies, a DNA-based immunization protocol is employed in which a mammalian expression vector encoding a 98P4B6 variant sequence is used to immunize mice by direct injection of the plasmid DNA. For example, amino acids 324-359 is cloned into the Tag5 mammalian secretion vector and the recombinant vector is used as immunogen. In another example the same amino acids are cloned into an Fc-fusion secretion vector in which the 98P4B6 variant 1 sequence is fused at the amino-terminus to an IgK leader sequence and at the carboxyl-terminus to the coding sequence of the human or murine IgG Fc region. This recombinant vector is then used as immunogen. The plasmid immunization protocols are used in combination with purified proteins expressed from the same vector and with cells expressing the respective 98P4B6 variant.

During the immunization protocol, test bleeds are taken 7-10 days following an injection to monitor titer and specificity of the immune response. Once appropriate reactivity and specificity is obtained as determined by ELISA, Western blotting, immunoprecipitation, fluorescence microscopy, and flow cytometric analyses, fusion and hybridoma generation is then carried out with established procedures well known in the art (see, e.g., Harlow and Lane, 1988).

In one embodiment for generating 98P4B6 monoclonal antibodies, a Tag5-98P4B6 variant 1 antigen encoding amino acids 324-359, is expressed and purified from stably transfected 293T cells. Balb C mice are initially immunized intraperitoneally with 25 µg of the Tag5-98P4B6 variant 1 protein mixed in complete Freund's adjuvant. Mice are subsequently immunized every two weeks with 25 µg of the antigen mixed in incomplete Freund's adjuvant for a total of three immunizations. ELISA using the Tag5 antigen determines the titer of serum from immunized mice. Reactivity and specificity of serum to full length 98P4B6 variant 1 protein is monitored by Western blotting, immunoprecipitation and flow cytometry using 293T cells transfected with an expression vector encoding the 98P4B6 variant 1 cDNA (see e.g., the Example entitled "Production of Recombinant 98P4B6 in Eukaryotic Systems" and FIG. 20). Other recombinant 98P4B6 variant 1-expressing cells or cells endogenously expressing 98P4B6 variant 1 are also used. Mice showing the strongest reactivity are rested and given a final injection of Tag5 antigen in PBS and then sacrificed four days later. The spleens of the sacrificed mice are harvested and fused to SPO/2 myeloma cells using standard procedures (Harlow and Lane, 1988). Supernatants from HAT selected growth wells are screened by ELISA, Western blot, immunoprecipitation, fluorescent microscopy, and flow cytometry to identify 98P4B6 specific antibody-producing clones.

To generate monoclonal antibodies that are specific for each 98P4B6 variant protein, immunogens are designed to encode sequences unique for each variant. In one embodiment, a Tag5 antigen encoding the full sequence of 98P4B6 variant 2 (M 1-45) is produced, purified and used as immunogen to derive monoclonal antibodies specific to 98P4B6 variant 2. In another embodiment, an antigenic peptide composed of amino acids 400-410 of 98P4B6 variant 5 is coupled to KLH and used as immunogen. In another embodiment, a GST fusion protein encoding amino acids 455-490 of 98P4B6 of variant 6 is used as immunogen to derive variant 6 specific monoclonal antibodies. In another embodiment, a peptide composed of amino acids 472-498 of variant 7 is coupled to KLH and used as immunogen to generate variant 7 specific monoclonal antibodies. Hybridoma supernatants are then screened on the respective antigen and then further screened on cells expressing the specific variant and cross-screened on cells expressing the other variants to derive variant-specific monoclonal antibodies.

The binding affinity of a 98P4B6 variant monoclonal antibody is determined using standard technologies. Affinity measurements quantify the strength of antibody to epitope binding and are used to help define which 98P4B6 variant monoclonal antibodies preferred for diagnostic or therapeutic use, as appreciated by one of skill in the art. The BIAcore system (Uppsala, Sweden) is a preferred method for determining binding affinity. The BIAcore system uses surface plasmon resonance (SPR, Welford K. 1991, Opt. Quant. Elect. 23:1; Morton and Myszka, 1998, Methods in Enzymology 295: 268) to monitor biomolecular interactions in real time. BIAcore analysis conveniently generates association rate constants, dissociation rate constants, equilibrium dissociation constants, and affinity constants.

Example 12

HLA Class I and Class II Binding Assays

HLA class I and class II binding assays using purified HLA molecules are performed in accordance with disclosed protocols (e.g., PCT publications WO 94/20127 and WO 94/03205; Sidney et al., Current Protocols in Immunology 18.3.1 (1998); Sidney, et al., *J. Immunol.* 154:247 (1995); Sette et al., *Mol. Immunol.* 31:813 (1994)). Briefly, purified MHC molecules (5 to 500 nM) are incubated with various unlabeled peptide inhibitors and 1-10 $nM^{125}$I-radiolabeled probe peptides as described. Following incubation, MHC-peptide complexes are separated from free peptide by gel filtration and the fraction of peptide bound is determined. Typically, in preliminary experiments, each MHC preparation is titered in the presence of fixed amounts of radiolabeled peptides to determine the concentration of HLA molecules necessary to bind 10-20% of the total radioactivity. All subsequent inhibition and direct binding assays are performed using these HLA concentrations.

Since under these conditions [label]<[HLA] and $IC_{50} \geq$ [HLA], the measured $IC_{50}$ values are reasonable approximations of the true $K_D$ values. Peptide inhibitors are typically tested at concentrations ranging from 120 µg/ml to 1.2 ng/ml, and are tested in two to four completely independent experiments. To allow comparison of the data obtained in different experiments, a relative binding figure is calculated for each peptide by dividing the $IC_{50}$ of a positive control for inhibition by the $IC_{50}$ for each tested peptide (typically unlabeled versions of the radiolabeled probe peptide). For database purposes, and inter-experiment comparisons, relative binding values are compiled. These values can subsequently be converted back into IC$_{50}$ nM values by dividing the IC$_{50}$ nM of the positive controls for inhibition by the relative binding of the peptide of interest. This method of data compilation is accurate and consistent for comparing peptides that have been tested on different days, or with different lots of purified MHC.

Binding assays as outlined above may be used to analyze HLA supermotif and/or HLA motif-bearing peptides (see Table IV).

Example 13

Identification of HLA Supermotif- and Motif-Bearing CTL Candidate Epitopes

HLA vaccine compositions of the invention can include multiple epitopes. The multiple epitopes can comprise multiple HLA supermotifs or motifs to achieve broad population coverage. This example illustrates the identification and confirmation of supermotif- and motif-bearing epitopes for the inclusion in such a vaccine composition. Calculation of population coverage is performed using the strategy described below.

Computer Searches and Algorithms for Identification of Supermotif and/or Motif-Bearing Epitopes The searches performed to identify the motif-bearing peptide sequences in the Example entitled "Antigenicity Profiles" and Tables VIII-XXI and XXII-XLIX employ the protein sequence data from the gene product of 98P4B6 set forth in FIGS. 2 and 3, the specific search peptides used to generate the tables are listed in Table VII.

Computer searches for epitopes bearing HLA Class I or Class II supermotifs or motifs are performed as follows. All translated 98P4B6 protein sequences are analyzed using a text string search software program to identify potential peptide sequences containing appropriate HLA binding motifs; such programs are readily produced in accordance with information in the art in view of known motif/supermotif disclosures. Furthermore, such calculations can be made mentally.

Identified A2-, A3-, and DR-supermotif sequences are scored using polynomial algorithms to predict their capacity to bind to specific HLA-Class I or Class II molecules. These polynomial algorithms account for the impact of different amino acids at different positions, and are essentially based on the premise that the overall affinity (or ΔG) of peptide-HLA molecule interactions can be approximated as a linear polynomial function of the type:

$$\text{"}\Delta G\text{"} = a_{1i} \times a_{2i} \times a_{3i} \ldots \times a_{ni}$$

where $a_{ji}$ is a coefficient which represents the effect of the presence of a given amino acid (j) at a given position (i) along the sequence of a peptide of n amino acids. The crucial assumption of this method is that the effects at each position are essentially independent of each other (i.e., independent binding of individual side-chains). When residue j occurs at position i in the peptide, it is assumed to contribute a constant amount ji to the free energy of binding of the peptide irrespective of the sequence of the rest of the peptide.

The method of derivation of specific algorithm coefficients has been described in Gulukota et al., *J. Mol. Biol.* 267:1258-126, 1997; (see also Sidney et al., *Human Immunol.* 45:79-93, 1996; and Southwood et al., *J. Immunol.* 160:3363-3373, 1998). Briefly, for all i positions, anchor and non-anchor alike, the geometric mean of the average relative binding (ARB) of all peptides carrying j is calculated relative to the remainder of the group, and used as the estimate of ji. For Class II peptides, if multiple alignments are possible, only the highest scoring alignment is utilized, following an iterative procedure. To calculate an algorithm score of a given peptide in a test set, the ARB values corresponding to the sequence of the peptide are multiplied. If this product exceeds a chosen threshold, the peptide is predicted to bind. Appropriate thresholds are chosen as a function of the degree of stringency of prediction desired.

Selection of HLA-A2 Supertype Cross-Reactive Peptides

Protein sequences from 98P4B6 are scanned utilizing motif identification software, to identify 8-, 9- 10- and 11-mer sequences containing the HLA-A2-supermotif main anchor specificity. Typically, these sequences are then scored using the protocol described above and the peptides corresponding to the positive-scoring sequences are synthesized and tested for their capacity to bind purified HLA-A*0201 molecules in vitro (HLA-A*0201 is considered a prototype A2 supertype molecule).

These peptides are then tested for the capacity to bind to additional A2-supertype molecules (A*0202, A*0203, A*0206, and A*6802). Peptides that bind to at least three of the five A2-supertype alleles tested are typically deemed A2-supertype cross-reactive binders. Preferred peptides bind at an affinity equal to or less than 500 nM to three or more HLA-A2 supertype molecules.

Selection of HLA-A3 Supermotif-Bearing Epitopes

The 98P4B6 protein sequence(s) scanned above is also examined for the presence of peptides with the HLA-A3-supermotif primary anchors. Peptides corresponding to the HLA A3 supermotif-bearing sequences are then synthesized and tested for binding to HLA-A*0301 and HLA-A*1101 molecules, the molecules encoded by the two most prevalent A3-supertype alleles. The peptides that bind at least one of the two alleles with binding affinities of ≦500 nM, often ≦200 nM, are then tested for binding cross-reactivity to the other common A3-supertype alleles (e.g., A*3101, A*3301, and A*6801) to identify those that can bind at least three of the five HLA-A3-supertype molecules tested.

Selection of HLA-B7 Supermotif Bearing Epitopes

The 98P4B6 protein(s) scanned above is also analyzed for the presence of 8-, 9- 10-, or 11-mer peptides with the HLA-B7-supermotif. Corresponding peptides are synthesized and tested for binding to HLA-B*0702, the molecule encoded by the most common B7-supertype allele (i.e., the prototype B7 supertype allele). Peptides binding B*0702 with IC$_{50}$ of ≦500 nM are identified using standard methods. These peptides are then tested for binding to other common B7-supertype molecules (e.g., B*3501, B*5101, B*5301, and B*5401). Peptides capable of binding to three or more of the five B7-supertype alleles tested are thereby identified.

Selection of A1 and A24 Motif-Bearing Epitopes

To further increase population coverage, HLA-A1 and -A24 epitopes can also be incorporated into vaccine compositions. An analysis of the 98P4B6 protein can also be performed to identify HLA-A1- and A24-motif-containing sequences.

High affinity and/or cross-reactive binding epitopes that bear other motif and/or supermotifs are identified using analogous methodology.

Example 14

Confirmation of Immunogenicity

Cross-reactive candidate CTL A2-supermotif-bearing peptides that are identified as described herein are selected to confirm in vitro immunogenicity. Confirmation is performed using the following methodology:

Target Cell Lines for Cellular Screening:

The 0.221A2.1 cell line, produced by transferring the HLA-A2.1 gene into the HLA-A, -B, -C null mutant human B-lymphoblastoid cell line 721.221, is used as the peptide-loaded target to measure activity of HLA-A2.1-restricted CTL. This cell line is grown in RPMI-1640 medium supplemented with antibiotics, sodium pyruvate, nonessential amino acids and 10% (v/v) heat inactivated FCS. Cells that express an antigen of interest, or transfectants comprising the gene encoding the antigen of interest, can be used as target cells to confirm the ability of peptide-specific CTLs to recognize endogenous antigen.

Primary CTL Induction Cultures:

Generation of Dendritic Cells (DC): PBMCs are thawed in RPMI with 30 μg/ml DNAse, washed twice and resuspended in complete medium (RPMI-1640 plus 5% AB human serum, non-essential amino acids, sodium pyruvate, L-glutamine and penicillin/streptomycin). The monocytes are purified by plating $10\times10^6$ PBMC/well in a 6-well plate. After 2 hours at 37° C., the non-adherent cells are removed by gently shaking the plates and aspirating the supernatants. The wells are washed a total of three times with 3 ml RPMI to remove most of the non-adherent and loosely adherent cells. Three ml of complete medium containing 50 ng/ml of GM-CSF and 1,000 U/ml of IL-4 are then added to each well. TNFα is added to the DCs on day 6 at 75 ng/ml and the cells are used for CTL induction cultures on day 7.

Induction of CTL with DC and Peptide: CD8+ T-cells are isolated by positive selection with Dynal immunomagnetic beads (Dynabeads® M-450) and the detacha-bead® reagent. Typically about $200\text{-}250\times10^6$ PBMC are processed to obtain $24\times106$ CD8+ T-cells (enough for a 48-well plate culture). Briefly, the PBMCs are thawed in RPMI with 30 μg/ml DNAse, washed once with PBS containing 1% human AB serum and resuspended in PBS/1% AB serum at a concentration of $20\times10^6$ cells/ml. The magnetic beads are washed 3 times with PBS/AB serum, added to the cells (140 μl beads/$20\times10^6$ cells) and incubated for 1 hour at 4° C. with continuous mixing. The beads and cells are washed 4× with PBS/AB serum to remove the nonadherent cells and resuspended at $100\times10^6$ cells/ml (based on the original cell number) in PBS/AB serum containing 100 μl/ml detacha-bead® reagent and 30 μg/ml DNAse. The mixture is incubated for 1 hour at room temperature with continuous mixing. The beads are washed again with PBS/AB/DNAse to collect the CD8+ T-cells. The DC are collected and centrifuged at 1300 rpm for 5-7 minutes, washed once with PBS with 1% BSA, counted and pulsed with 40μg/ml of peptide at a cell concentration of $1\text{-}2\times10^6$/ml in the presence of 3 μg/ml $\beta_2$-microglobulin for 4 hours at 20° C. The DC are then irradiated (4,200 rads), washed 1 time with medium and counted again.

Setting up induction cultures: 0.25 ml cytokine-generated DC (at $1\times10^5$ cells/ml) are co-cultured with 0.25 ml of CD8+ T-cells (at $2\times10^6$ cell/ml) in each well of a 48-well plate in the presence of 10 ng/ml of IL-7. Recombinant human IL-10 is added the next day at a final concentration of 10 ng/ml and rhuman IL-2 is added 48 hours later at 10 IU/ml.

Restimulation of the induction cultures with peptide-pulsed adherent cells: Seven and fourteen days after the primary induction, the cells are restimulated with peptide-pulsed adherent cells. The PBMCs are thawed and washed twice with RPMI and DNAse. The cells are resuspended at $5\times10^6$ cells/ml and irradiated at ~4200 rads. The PBMCs are plated at $2\times10^6$ in 0.5 ml complete medium per well and incubated for 2 hours at 37° C. The plates are washed twice with RPMI by tapping the plate gently to remove the nonadherent cells and the adherent cells pulsed with 10 g/ml of peptide in the presence of 3 μg/ml 92 microglobulin in 0.25ml RPMI/5%AB per well for 2 hours at 37° C. Peptide solution from each well is aspirated and the wells are washed once with RPMI. Most of the media is aspirated from the induction cultures (CD8+ cells) and brought to 0.5 ml with fresh media. The cells are then transferred to the wells containing the peptide-pulsed adherent cells. Twenty four hours later recombinant human IL-10 is added at a final concentration of 10 ng/ml and recombinant human IL2 is added the next day and again 2-3 days later at 50 IU/ml (Tsai et al., *Critical Reviews in Immunology* 18(1-2):65-75, 1998). Seven days later, the cultures are assayed for CTL activity in a $^{51}$Cr release assay. In some experiments the cultures are assayed for peptide-specific recognition in the in situ IFNγ ELISA at the time of the second restimulation followed by assay of endogenous recognition 7 days later. After expansion, activity is measured in both assays for a side-by-side comparison.

Measurement of CTL Lytic Activity by $^{51}$Cr Release.

Seven days after the second restimulation, cytotoxicity is determined in a standard (5 hr) $^{51}$Cr release assay by assaying individual wells at a single E:T. Peptide-pulsed targets are prepared by incubating the cells with 10 μg/ml peptide overnight at 37° C.

Adherent target cells are removed from culture flasks with trypsin-EDTA. Target cells are labeled with 200 μCl of $^{51}$Cr sodium chromate (DuPont, Wilmington, Del.) for 1 hour at 37° C. Labeled target cells are resuspended at $10^6$ per ml and diluted 1:10 with K562 cells at a concentration of $3.3\times10^6$/ml (an NK-sensitive erythroblastoma cell line used to reduce non-specific lysis). Target cells (100 μl) and effectors (100μl) are plated in 96 well round-bottom plates and incubated for 5 hours at 37° C. At that time, 100 μl of supernatant are collected from each well and percent lysis is determined according to the formula:

[(cpm of the test sample–cpm of the spontaneous $^{51}$Cr release sample)/(cpm of the maximal $^{51}$Cr release sample–cpm of the spontaneous $^{51}$Cr release sample)]×100.

Maximum and spontaneous release are determined by incubating the labeled targets with 1% Triton X-100 and media alone, respectively. A positive culture is defined as one in which the specific lysis (sample-background) is 10% or higher in the case of individual wells and is 15% or more at the two highest E:T ratios when expanded cultures are assayed.

In situ Measurement of Human IFNγ Production as an Indicator of Peptide-specific and Endogenous Recognition Immulon 2 plates are coated with mouse anti-human IFNγ monoclonal antibody (4 μg/ml 0.1M NaHCO$_3$, pH8.2) overnight at 4° C. The plates are washed with Ca$^{2+}$, Mg$^{2+}$-free PBS/0.05% Tween 20 and blocked with PBS/10% FCS for two hours, after which the CTLs (100 μl/well) and targets (100 μl/well) are added to each well, leaving empty wells for the standards and blanks (which received media only). The target cells, either peptide-pulsed or endogenous targets, are used at a concentration of $1\times10^6$ cells/ml. The plates are incubated for 48 hours at 37° C. with 5% CO$_2$.

Recombinant human IFN-gamma is added to the standard wells starting at 400 pg or 1200 pg/100 microliter/well and the plate incubated for two hours at 37° C. The plates are washed and 100 μl of biotinylated mouse anti-human IFN-gamma monoclonal antibody (2 microgram/ml in PBS/3% FCS/0.05% Tween 20) are added and incubated for 2 hours at room temperature. After washing again, 100 microliter HRP-streptavidin (1:4000) are added and the plates incubated for one hour at room temperature. The plates are then washed 6× with wash buffer, 100 microliter/well developing solution (TMB 1:1) are added, and the plates allowed to develop for 5-15 minutes. The reaction is stopped with 50 microliter/well 1M $H_3PO_4$ and read at OD450. A culture is considered positive if it measured at least 50 pg of IFN-gamma/well above background and is twice the background level of expression.

CTL Expansion.

Those cultures that demonstrate specific lytic activity against peptide-pulsed targets and/or tumor targets are expanded over a two week period with anti-CD3. Briefly, $5\times10^4$ CD8+ cells are added to a T25 flask containing the following: $1\times10^6$ irradiated (4,200 rad) PBMC (autologous or allogeneic) per ml, $2\times10^5$ irradiated (8,000 rad) EBV-transformed cells per ml, and OKT3 (anti-CD3) at 30ng per ml in RPMI-1640 containing 10% (v/v) human AB serum, non-essential amino acids, sodium pyruvate, 25 µM 2-mercaptoethanol, L-glutamine and penicillin/streptomycin. Recombinant human IL2 is added 24 hours later at a final concentration of 200 IU/ml and every three days thereafter with fresh media at 50 IU/mi. The cells are split if the cell concentration exceeds $1\times10^6$/ml and the cultures are assayed between days 13 and 15 at E:T ratios of 30, 10, 3 and 1:1 in the $^{51}$Cr release assay or at $1\times10^6$/ml in the in situ IFNγ assay using the same targets as before the expansion.

Cultures are expanded in the absence of anti-CD3, as follows. Those cultures that demonstrate specific lytic activity against peptide and endogenous targets are selected and $5\times10^4$ CD8+ cells are added to a T25 flask containing the following: $1\times10^6$ autologous PBMC per ml which have been peptide-pulsed with 10 µg/ml peptide for two hours at 37° C. and irradiated (4,200 rad); $2\times10^5$ irradiated (8,000 rad) EBV-transformed cells per ml RPMI-1640 containing 10% (v/v) human AB serum, non-essential AA, sodium pyruvate, 25 mM 2-ME, L-glutamine and gentamicin.

Immunogenicity of A2 Supermotif-Bearing Peptides

A2-supermotif cross-reactive binding peptides are tested in the cellular assay for the ability to induce peptide-specific CTL in normal individuals. In this analysis, a peptide is typically considered to be an epitope if it induces peptide-specific CTLs in at least individuals, and preferably, also recognizes the endogenously expressed peptide.

Immunogenicity can also be confirmed using PBMCs isolated from patients bearing a tumor that expresses 98P4B6. Briefly, PBMCs are isolated from patients, re-stimulated with peptide-pulsed monocytes and assayed for the ability to recognize peptide-pulsed target cells as well as transfected cells endogenously expressing the antigen.

Evaluation of A*03/A11 Immunogenicity

HLA-A3 supermotif-bearing cross-reactive binding peptides are also evaluated for immunogenicity using methodology analogous for that used to evaluate the immunogenicity of the HLA-A2 supermotif peptides.

Evaluation of B7 Immunogenicity

Immunogenicity screening of the B7-supertype cross-reactive binding peptides identified as set forth herein are confirmed in a manner analogous to the confirmation of A2-and A3-supermotif-bearing peptides.

Peptides bearing other supermotifs/motifs, e.g., HLA-A1, HLA-A24 etc. are also confirmed using similar methodology.

Example 15

Implementation of the Extended Supermotif to Improve the Binding Capacity of Native Epitopes by Creating Analogs HLA motifs and supermotifs (comprising primary and/or secondary residues) are useful in the identification and preparation of highly cross-reactive native peptides, as demonstrated herein. Moreover, the definition of HLA motifs and supermotifs also allows one to engineer highly cross-reactive epitopes by identifying residues within a native peptide sequence which can be analoged to confer upon the peptide certain characteristics, e.g. greater cross-reactivity within the group of HLA molecules that comprise a supertype, and/or greater binding affinity for some or all of those HLA molecules. Examples of analoging peptides to exhibit modulated binding affinity are set forth in this example.

Analoging at Primary Anchor Residues

Peptide engineering strategies are implemented to further increase the cross-reactivity of the epitopes. For example, the main anchors of A2-supermotif-bearing peptides are altered, for example, to introduce a preferred L, I, V, or M at position 2, and I or V at the C-terminus.

To analyze the cross-reactivity of the analog peptides, each engineered analog is initially tested for binding to the prototype A2 supertype allele A*0201, then, if A*0201 binding capacity is maintained, for A2-supertype cross-reactivity.

Alternatively, a peptide is confirmed as binding one or all supertype members and then analoged to modulate binding affinity to any one (or more) of the supertype members to add population coverage.

The selection of analogs for immunogenicity in a cellular screening analysis is typically further restricted by the capacity of the parent wild type (WT) peptide to bind at least weakly, i.e., bind at an $IC_{50}$ of 5000 nM or less, to three of more A2 supertype alleles. The rationale for this requirement is that the WT peptides must be present endogenously in sufficient quantity to be biologically relevant. Analoged peptides have been shown to have increased immunogenicity and cross-reactivity by T cells specific for the parent epitope (see, e.g., Parkhurst et al., *J. Immunol.* 157:2539, 1996; and Pogue et al., *Proc. Natl. Acad. Sci. USA* 92:8166,1995).

In the cellular screening of these peptide analogs, it is important to confirm that analog-specific CTLs are also able to recognize the wild-type peptide and, when possible, target cells that endogenously express the epitope.

Analoging of HLA-A3 and B7-Supermotif-Bearing Peptides

Analogs of HLA-A3 supermotif-bearing epitopes are generated using strategies similar to those employed in analoging HLA-A2 supermotif-bearing peptides. For example, peptides binding to ⅗ of the A3-supertype molecules are engineered at primary anchor residues to possess a preferred residue (V, S, M, or A) at position 2.

The analog peptides are then tested for the ability to bind A*03 and A*11 (prototype A3 supertype alleles). Those peptides that demonstrate ≦500 nM binding capacity are then confirmed as having A3-supertype cross-reactivity.

Similarly to the A2- and A3-motif bearing peptides, peptides binding 3 or more B7-supertype alleles can be improved, where possible, to achieve increased cross-reactive binding or greater binding affinity or binding half life. B7 supermotif-bearing peptides are, for example, engineered to possess a preferred residue (V, I, L, or F) at the C-terminal primary anchor position, as demonstrated by Sidney et al. (*J. Immunol.* 157:3480-3490, 1996).

Analoging at primary anchor residues of other motif and/or supermotif-bearing epitopes is performed in a like manner.

The analog peptides are then be confirmed for immunogenicity, typically in a cellular screening assay. Again, it is generally important to demonstrate that analog-specific CTLs are also able to recognize the wild-type peptide and, when possible, targets that endogenously express the epitope.

Analoging at Secondary Anchor Residues

Moreover, HLA supermotifs are of value in engineering highly cross-reactive peptides and/or peptides that bind HLA molecules with increased affinity by identifying particular residues at secondary anchor positions that are associated with such properties. For example, the binding capacity of a B7 supermotif-bearing peptide with an F residue at position 1 is analyzed. The peptide is then analoged to, for example, substitute L for F at position 1. The analoged peptide is evaluated for increased binding affinity, binding half life and/or increased cross-reactivity. Such a procedure identifies analoged peptides with enhanced properties.

Engineered analogs with sufficiently improved binding capacity or cross-reactivity can also be tested for immunogenicity in HLA-B7-transgenic mice, following for example, IFA immunization or lipopeptide immunization. Analoged peptides are additionally tested for the ability to stimulate a recall response using PBMC from patients with 98P4B6-expressing tumors.

Other Analoging Strategies

Another form of peptide analoging, unrelated to anchor positions, involves the substitution of a cysteine with α-amino butyric acid. Due to its chemical nature, cysteine has the propensity to form disulfide bridges and sufficiently alter the peptide structurally so as to reduce binding capacity. Substitution of α-amino butyric acid for cysteine not only alleviates this problem, but has been shown to improve binding and crossbinding capabilities in some instances (see, e.g., the review by Sette et al., In: Persistent Viral Infections, Eds. R. Ahmed and I. Chen, John Wiley & Sons, England, 1999).

Thus, by the use of single amino acid substitutions, the binding properties and/or cross-reactivity of peptide ligands for HLA supertype molecules can be modulated.

Example 16

Identification and Confirmation of 98P4B6-Derived Sequences With HLA-DR Binding Motifs Peptide epitopes bearing an HLA class II supermotif or motif are identified and confirmed as outlined below using methodology similar to that described for HLA Class I peptides.

Selection of HLA-DR-Supermotif-Bearing Epitopes.

To identify 98P4B6-derived, HLA class II HTL epitopes, a 98P4B6 antigen is analyzed for the presence of sequences bearing an HLA-DR-motif or supermotif. Specifically, 15-mer sequences are selected comprising a DR-supermotif, comprising a 9-mer core, and three-residue N- and C-terminal flanking regions (15 amino acids total).

Protocols for predicting peptide binding to DR molecules have been developed (Southwood et al., *J. Immunol.* 160: 3363-3373, 1998). These protocols, specific for individual DR molecules, allow the scoring, and ranking, of 9-mer core regions. Each protocol not only scores peptide sequences for the presence of DR-supermotif primary anchors (i.e., at position 1 and position 6) within a 9-mer core, but additionally evaluates sequences for the presence of secondary anchors. Using allele-specific selection tables (see, e.g., Southwood et al., ibid.), it has been found that these protocols efficiently select peptide sequences with a high probability of binding a particular DR molecule. Additionally, it has been found that performing these protocols in tandem, specifically those for DR1, DR4w4, and DR7, can efficiently select DR cross-reactive peptides.

The 98P4B6-derived peptides identified above are tested for their binding capacity for various common HLA-DR molecules. All peptides are initially tested for binding to the DR molecules in the primary panel: DR1, DR4w4, and DR7. Peptides binding at least two of these three DR molecules are then tested for binding to DR2w2 β1, DR2w2 β2, DR6w19, and DR9 molecules in secondary assays. Finally, peptides binding at least two of the four secondary panel DR molecules, and thus cumulatively at least four of seven different DR molecules, are screened for binding to DR4w15, DR5w11, and DR8w2 molecules in tertiary assays. Peptides binding at least seven of the ten DR molecules comprising the primary, secondary, and tertiary screening assays are considered cross-reactive DR binders. 98P4B6-derived peptides found to bind common HLA-DR alleles are of particular interest.

Selection of DR3 Motif Peptides

Because HLA-DR3 is an allele that is prevalent in Caucasian, Black, and Hispanic populations, DR3 binding capacity is a relevant criterion in the selection of HTL epitopes. Thus, peptides shown to be candidates may also be assayed for their DR3 binding capacity. However, in view of the binding specificity of the DR3 motif, peptides binding only to DR3 can also be considered as candidates for inclusion in a vaccine formulation.

To efficiently identify peptides that bind DR3, target 98P4B6 antigens are analyzed for sequences carrying one of the two DR3-specific binding motifs reported by Geluk et al. (*J. Immunol.* 152:5742-5748, 1994). The corresponding peptides are then synthesized and confirmed as having the ability to bind DR3 with an affinity of 1 µM or better, i.e., less than 1 µM. Peptides are found that meet this binding criterion and qualify as HLA class II high affinity binders.

DR3 binding epitopes identified in this manner are included in vaccine compositions with DR supermotif-bearing peptide epitopes.

Similarly to the case of HLA class I motif-bearing peptides, the class II motif-bearing peptides are analoged to improve affinity or cross-reactivity. For example, aspartic acid at position 4 of the 9-mer core sequence is an optimal residue for DR3 binding, and substitution for that residue often improves DR 3 binding.

Example 17

Immunogenicity of 98P4B6-Derived HTL Epitopes

This example determines immunogenic DR supermotif- and DR3 motif-bearing epitopes among those identified using the methodology set forth herein.

Immunogenicity of HTL epitopes are confirmed in a manner analogous to the determination of immunogenicity of CTL epitopes, by assessing the ability to stimulate HTL responses and/or by using appropriate transgenic mouse models. Immunogenicity is determined by screening for: 1.)

in vitro primary induction using normal PBMC or 2.) recall responses from patents who have 98P4B6-expressing tumors.

Example 18

Calculation of Phenotypic Frequencies of HLA-Supertypes in Various Ethnic Backgrounds to Determine Breadth of Population Coverage This example illustrates the assessment of the breadth of population coverage of a vaccine composition comprised of multiple epitopes comprising multiple supermotifs and/or motifs.

In order to analyze population coverage, gene frequencies of HLA alleles are determined. Gene frequencies for each HLA allele are calculated from antigen or allele frequencies utilizing the binomial distribution formulae gf=1-(SQRT(1-af)) (see, e.g., Sidney et al., *Human Immunol.* 45:79-93, 1996). To obtain overall phenotypic frequencies, cumulative gene frequencies are calculated, and the cumulative antigen frequencies derived by the use of the inverse formula [af=1--(1-Cgf)$^2$].

Where frequency data is not available at the level of DNA typing, correspondence to the serologically defined antigen frequencies is assumed. To obtain total potential supertype population coverage no linkage disequilibrium is assumed, and only alleles confirmed to belong to each of the supertypes are included (minimal estimates). Estimates of total potential coverage achieved by inter-loci combinations are made by adding to the A coverage the proportion of the non-A covered population that could be expected to be covered by the B alleles considered (e.g., total=A+B*(1-A)). Confirmed members of the A3-like supertype are A3, A11, A31, A*3301, and A*6801. Although the A3-like supertype may also include A34, A66, and A*7401, these alleles were not included in overall frequency calculations. Likewise, confirmed members of the A2-like supertype family are A*0201, A*0202, A*0203, A*0204, A*0205, A*0206, A*0207, A*6802, and A*6901. Finally, the B7-like supertype-confirmed alleles are: B7, B*3501-03, B51, B*5301, B*5401, B*5501-2, B*5601, B*6701, and B*7801 (potentially also B*1401, B*3504-06, B*4201, and B*5602).

Population coverage achieved by combining the A2-, A3- and B7-supertypes is approximately 86% in five major ethnic groups. Coverage may be extended by including peptides bearing the A1 and A24 motifs. On average, A1 is present in 12% and A24 in 29% of the population across five different major ethnic groups (Caucasian, North American Black, Chinese, Japanese, and Hispanic). Together, these alleles are represented with an average frequency of 39% in these same ethnic populations. The total coverage across the major ethnicities when A1 and A24 are combined with the coverage of the A2-, A3- and B7-supertype alleles is >95%, see, e.g., Table IV (G). An analogous approach can be used to estimate population coverage achieved with combinations of class II motif-bearing epitopes.

Immunogenicity studies in humans (e.g., Bertoni et al., *J. Clin. Invest.* 100:503, 1997; Doolan et al., *Immunity* 7:97, 1997; and Threlkeld et al., *J. Immunol.* 159:1648, 1997) have shown that highly cross-reactive binding peptides are almost always recognized as epitopes. The use of highly cross-reactive binding peptides is an important selection criterion in identifying candidate epitopes for inclusion in a vaccine that is immunogenic in a diverse population.

With a sufficient number of epitopes (as disclosed herein and from the art), an average population coverage is predicted to be greater than 95% in each of five major ethnic populations. The game theory Monte Carlo simulation analysis, which is known in the art (see e.g., Osborne, M. J. and Rubinstein, A. "A course in game theory" MIT Press, 1994), can be used to estimate what percentage of the individuals in a population comprised of the Caucasian, North American Black, Japanese, Chinese, and Hispanic ethnic groups would recognize the vaccine epitopes described herein. A preferred percentage is 90%. A more preferred percentage is 95%.

Example 19

CTL Recognition Of Endogenously Processed Antigens After Priming

This example confirms that CTL induced by native or analoged peptide epitopes identified and selected as described herein recognize endogenously synthesized, i.e., native antigens.

Effector cells isolated from transgenic mice that are immunized with peptide epitopes, for example HLA-A2 supermotif-bearing epitopes, are re-stimulated in vitro using peptide-coated stimulator cells. Six days later, effector cells are assayed for cytotoxicity and the cell lines that contain peptide-specific cytotoxic activity are further re-stimulated. An additional six days later, these cell lines are tested for cytotoxic activity on $^{51}$Cr labeled Jurkat-A2.1/K$^b$ target cells in the absence or presence of peptide, and also tested on $^{51}$Cr labeled target cells bearing the endogenously synthesized antigen, i.e. cells that are stably transfected with 98P4B6 expression vectors.

The results demonstrate that CTL lines obtained from animals primed with peptide epitope recognize endogenously synthesized 98P4B6 antigen. The choice of transgenic mouse model to be used for such an analysis depends upon the epitope(s) that are being evaluated. In addition to HLA-A*0201/K$^b$ transgenic mice, several other transgenic mouse models including mice with human A11, which may also be used to evaluate A3 epitopes, and B7 alleles have been characterized and others (e.g., transgenic mice for HLA-A1 and A24) are being developed. HLA-DR1 and HLA-DR3 mouse models have also been developed, which may be used to evaluate HTL epitopes.

Example 20

Activity of CTL-HTL Conjugated Epitopes in Transgenic Mice

This example illustrates the induction of CTLs and HTLs in transgenic mice, by use of a 98P4B6-derived CTL and HTL peptide vaccine compositions. The vaccine composition used herein comprise peptides to be administered to a patient with a 98P4B6-expressing tumor. The peptide composition can comprise multiple CTL and/or HTL epitopes. The epitopes are identified using methodology as described herein. This example also illustrates that enhanced immunogenicity can be achieved by inclusion of one or more HTL epitopes in a CTL vaccine composition; such a peptide composition can comprise an HTL epitope conjugated to a CTL epitope. The CTL epitope can be one that binds to multiple HLA family members at an affinity of 500 nM or less, or analogs of that epitope. The peptides may be lipidated, if desired.

Immunization procedures: Immunization of transgenic mice is performed as described (Alexander et al., *J. Immunol.* 159:4753-4761,1997). For example, A2/K$^b$ mice, which are transgenic for the human HLAA2.1 allele and are used to confirm the immunogenicity of HLA-A*0201 motif- or HLA-A2 supermotif-bearing epitopes, and are primed subcutaneously (base of the tail) with a 0.1 ml of peptide in Incomplete Freund's Adjuvant, or if the peptide composition is a lipidated CTU/HTL conjugate, in DMSO/saline, or if the peptide composition is a polypeptide, in PBS or Incomplete Freund's Adjuvant. Seven days after priming, splenocytes obtained from these animals are restimulated with syngenic irradiated LPS-activated lymphoblasts coated with peptide.

Cell lines: Target cells for peptide-specific cytotoxicity assays are Jurkat cells transfected with the HLA-A2.1/$K^b$ chimeric gene (e.g., Vitiello et al., *J. Exp. Med.* 173:1007, 1991)

In vitro CTL activation: One week after priming, spleen cells ($30 \times 10^6$ cells/flask) are co-cultured at 37° C. with syngeneic, irradiated (3000 rads), peptide coated lymphoblasts ($10 \times 10^6$ cells/flask) in 10 ml of culture medium/T25 flask. After six days, effector cells are harvested and assayed for cytotoxic activity.

Assay for cytotoxic activity: Target cells (1.0 to $1.5 \times 106$) are incubated at 37° C. in the presence of 200 µl of $^{51}$Cr. After 60 minutes, cells are washed three times and resuspended in R10 medium. Peptide is added where required at a concentration of 1 µg/ml. For the assay, $10^4$ $^{51}$Cr-labeled target cells are added to different concentrations of effector cells (final volume of 200 µl) in U-bottom 96-well plates. After a six hour incubation period at 37° C., a 0.1 ml aliquot of supernatant is removed from each well and radioactivity is determined in a Micromedic automatic gamma counter. The percent specific lysis is determined by the formula: percent specific release=100×(experimental release−spontaneous release)/(maximum release−spontaneous release). To facilitate comparison between separate CTL assays run under the same conditions, % $^{51}$Cr release data is expressed as lytic units/$10^6$ cells. One lytic unit is arbitrarily defined as the number of effector cells required to achieve 30% lysis of 10,000 target cells in a six hour $^{51}$Cr release assay. To obtain specific lytic units/$10^6$, the lytic units/$10^6$ obtained in the absence of peptide is subtracted from the lytic units/$10^6$ obtained in the presence of peptide. For example, if 30% $^{51}$Cr release is obtained at the effector (E): target (T) ratio of 50:1 (i.e., $5 \times 10^5$ effector cells for 10,000 targets) in the absence of peptide and 5:1 (i.e., $5 \times 10^4$ effector cells for 10,000 targets) in the presence of peptide, the specific lytic units would be: [(1/50,000)−(1/500,000)]×$10^6$=18 LU.

The results are analyzed to assess the magnitude of the CTL responses of animals injected with the immunogenic CTUHTL conjugate vaccine preparation and are compared to the magnitude of the CTL response achieved using, for example, CTL epitopes as outlined above in the Example entitled "Confirmation of Immunogenicity." Analyses similar to this may be performed to confirm the immunogenicity of peptide conjugates containing multiple CTL epitopes and/or multiple HTL epitopes. In accordance with these procedures, it is found that a CTL response is induced, and concomitantly that an HTL response is induced upon administration of such compositions.

Example 21

Selection of CTL and HTL Epitopes for Inclusion in a 98P4B6-Specific Vaccine.

This example illustrates a procedure for selecting peptide epitopes for vaccine compositions of the invention. The peptides in the composition can be in the form of a nucleic acid sequence, either single or one or more sequences (i.e., minigene) that encodes peptide(s), or can be single and/or polyepitopic peptides.

The following principles are utilized when selecting a plurality of epitopes for inclusion in a vaccine composition. Each of the following principles is balanced in order to make the selection.

Epitopes are selected which, upon administration, mimic immune responses that are correlated with 98P4B6 clearance. The number of epitopes used depends on observations of patients who spontaneously clear 98P4B6. For example, if it has been observed that patients who spontaneously clear 98P4B6-expressing cells generate an immune response to at least three (3) epitopes from 98P4B6 antigen, then at least three epitopes should be included for HLA class I. A similar rationale is used to determine HLA class II epitopes.

Epitopes are often selected that have a binding affinity of an $IC_{50}$ of 500 nM or less for an HLA class I molecule, or for class II, an $IC_{50}$ of 1000 nM or less; or HLA Class I peptides with high binding scores from the BIMAS web site.

In order to achieve broad coverage of the vaccine through out a diverse population, sufficient supermotif bearing peptides, or a sufficient array of allele-specific motif bearing peptides, are selected to give broad population coverage. In one embodiment, epitopes are selected to provide at least 80% population coverage. A Monte Carlo analysis, a statistical evaluation known in the art, can be employed to assess breadth, or redundancy, of population coverage.

When creating polyepitopic compositions, or a minigene that encodes same, it is typically desirable to generate the smallest peptide possible that encompasses the epitopes of interest. The principles employed are similar, if not the same, as those employed when selecting a peptide comprising nested epitopes. For example, a protein sequence for the vaccine composition is selected because it has maximal number of epitopes contained within the sequence, i.e., it has a high concentration of epitopes. Epitopes may be nested or overlapping (i.e., frame shifted relative to one another). For example, with overlapping epitopes, two 9-mer epitopes and one 10-mer epitope can be present in a 10 amino acid peptide. Each epitope can be exposed and bound by an HLA molecule upon administration of such a peptide. A multi-epitopic, peptide can be generated synthetically, recombinantly, or via cleavage from the native source. Alternatively, an analog can be made of this native sequence, whereby one or more of the epitopes comprise substitutions that alter the cross-reactivity and/or binding affinity properties of the polyepitopic peptide. Such a vaccine composition is administered for therapeutic or prophylactic purposes. This embodiment provides for the possibility that an as yet undiscovered aspect of immune system processing will apply to the native nested sequence and thereby facilitate the production of therapeutic or prophylactic immune response-inducing vaccine compositions. Additionally such an embodiment provides for the possibility of motif-bearing epitopes for an HLA makeup that is presently unknown. Furthermore, this embodiment (absent the creating of any analogs) directs the immune response to multiple peptide sequences that are actually present in 98P4B6, thus avoiding the need to evaluate any junctional epitopes. Lastly, the embodiment provides an economy of scale when producing nucleic acid vaccine compositions. Related to this embodiment, computer programs can be derived in accordance with principles in the art, which identify in a target sequence, the greatest number of epitopes per sequence length.

A vaccine composition comprised of selected peptides, when administered, is safe, efficacious, and elicits an immune response similar in magnitude to an immune response that controls or clears cells that bear or overexpress 98P4B6.

Example 22

Construction of "Minigene" Multi-Epitope DNA Plasmids

This example discusses the construction of a minigene expression plasmid. Minigene plasmids may, of course, contain various configurations of B cell, CTL and/or HTL epitopes or epitope analogs as described herein.

A minigene expression plasmid typically includes multiple CTL and HTL peptide epitopes. In the present example, HLA-A2,-A3,-B7 supermotif-bearing peptide epitopes and HLA-A1 and -A24 motif-bearing peptide epitopes are used in conjunction with DR supermotif-bearing epitopes and/or DR3 epitopes. HLA class I supermotif or motif-bearing peptide epitopes derived 98P4B6, are selected such that multiple supermotifs/motifs are represented to ensure broad population coverage. Similarly, HLA class II epitopes are selected from 98P4B6 to provide broad population coverage, i.e. both HLA DR-1-4-7 supermotif-bearing epitopes and HLA DR-3 motif-bearing epitopes are selected for inclusion in the minigene construct. The selected CTL and HTL epitopes are then incorporated into a minigene for expression in an expression vector.

Such a construct may additionally include sequences that direct the HTL epitopes to the endoplasmic reticulum. For example, the Ii protein may be fused to one or more HTL epitopes as described in the art, wherein the CLIP sequence of the Ii protein is removed and replaced with an HLA class II epitope sequence so that HLA class II epitope is directed to the endoplasmic reticulum, where the epitope binds to an HLA class II molecules.

This example illustrates the methods to be used for construction of a minigene-bearing expression plasmid. Other expression vectors that may be used for minigene compositions are available and known to those of skill in the art.

The minigene DNA plasmid of this example contains a consensus Kozak sequence and a consensus murine kappa Ig-light chain signal sequence followed by CTL and/or HTL epitopes selected in accordance with principles disclosed herein. The sequence encodes an open reading frame fused to the Myc and His antibody epitope tag coded for by the pcDNA 3.1 Myc-His vector.

Overlapping oligonucleotides that can, for example, average about 70 nucleotides in length with 15 nucleotide overlaps, are synthesized and HPLC-purified. The oligonucleotides encode the selected peptide epitopes as well as appropriate linker nucleotides, Kozak sequence, and signal sequence. The final multiepitope minigene is assembled by extending the overlapping oligonucleotides in three sets of reactions using PCR. A Perkin/Elmer 9600 PCR machine is used and a total of 30 cycles are performed using the following conditions: 95° C. for 15 sec, annealing temperature (5° below the lowest calculated Tm of each primer pair) for 30 sec, and 72° C. for 1 min.

For example, a minigene is prepared as follows. For a first PCR reaction, 5 μg of each of two oligonucleotides are annealed and extended: In an example using eight oligonucleotides, i.e., four pairs of primers, oligonucleotides 1+2, 3+4, 5+6, and 7+8 are combined in 100 μl reactions containing Pfu polymerase buffer (1×=10 mM KCL, 10 mM (NH4)$_2$SO$_4$, 20 mM Tris-chloride, pH 8.75, 2 mM MgSO$_4$, 0.1% Triton X-100, 100 μg/ml BSA), 0.25 mM each dNTP, and 2.5 U of Pfu polymerase. The full-length dimer products are gel-purified, and two reactions containing the product of 1+2 and 3+4, and the product of 5+6 and 7+8 are mixed, annealed, and extended for 10 cycles. Half of the two reactions are then mixed, and 5 cycles of annealing and extension carried out before flanking primers are added to amplify the full length product. The full-length product is gel-purified and cloned into pCR-blunt (Invitrogen) and individual clones are screened by sequencing.

Example 23

The Plasmid Construct and the Degree to Which It Induces Immunogenicity.

The degree to which a plasmid construct, for example a plasmid constructed in accordance with the previous Example, is able to induce immunogenicity is confirmed in vitro by determining epitope presentation by APC following transduction or transfection of the APC with an epitope-expressing nucleic acid construct. Such a study determines "antigenicity" and allows the use of human APC. The assay determines whether the ability of the epitope to be presented by the APC in a context that is recognized by a T cell by quantifying the density of epitope-HLA class I complexes on the cell surface. Quantitation can be performed by directly measuring the amount of peptide eluted from the APC (see, e.g., Sijts et al., *J. Immunol.* 156:683-692, 1996; Demotz et al., *Nature* 342:682-684, 1989); or the number of peptide-HLA class I complexes can be estimated by measuring the amount of lysis or lymphokine release induced by diseased or transfected target cells, and then determining the concentration of peptide necessary to obtain equivalent levels of lysis or lymphokine release (see, e.g., Kageyama et al., *J. Immunol.* 154:567-576, 1995).

Alternatively, immunogenicity is confirmed through in vivo injections into mice and subsequent in vitro assessment of CTL and HTL activity, which are analyzed using cytotoxicity and proliferation assays, respectively, as detailed e.g., in Alexander et al., *Immunity* 1:751-761, 1994.

For example, to confirm the capacity of a DNA minigene construct containing at least one HLA-A2 supermotif peptide to induce CTLs in vivo, HLA-A2.1/K$^b$ transgenic mice, for example, are immunized intramuscularly with 100 μg of naked cDNA. As a means of comparing the level of CTLs induced by cDNA immunization, a control group of animals is also immunized with an actual peptide composition that comprises multiple epitopes synthesized as a single polypeptide as they would be encoded by the minigene.

Splenocytes from immunized animals are stimulated twice with each of the respective compositions (peptide epitopes encoded in the minigene or the polyepitopic peptide), then assayed for peptide-specific cytotoxic activity in a $^{51}$Cr release assay. The results indicate the magnitude of the CTL response directed against the A2-restricted epitope, thus indicating the in vivo immunogenicity of the minigene vaccine and polyepitopic vaccine.

It is, therefore, found that the minigene elicits immune responses directed toward the HLA-A2 supermotif peptide epitopes as does the polyepitopic peptide vaccine. A similar analysis is also performed using other HLA-A3 and HLA-B7 transgenic mouse models to assess CTL induction by HLA-A3 and HLA-B7 motif or supermotif epitopes, whereby it is also found that the minigene elicits appropriate immune responses directed toward the provided epitopes.

To confirm the capacity of a class II epitope-encoding minigene to induce HTLs in vivo, DR transgenic mice, or for those epitopes that cross react with the appropriate mouse MHC molecule, I-A$^b$-restricted mice, for example, are immunized intramuscularly with 100 μg of plasmid DNA. As a means of comparing the level of HTLs induced by DNA immunization, a group of control animals is also immunized with an actual peptide composition emulsified in complete Freund's adjuvant. CD4+ T cells, i.e. HTLs, are purified from splenocytes of immunized animals and stimulated with each of the respective compositions (peptides encoded in the minigene). The HTL response is measured using a $^3$H-thymidine incorporation proliferation assay, (see, e.g., Alexander et al. Immunity 1:751-761, 1994). The results indicate the magnitude of the HTL response, thus demonstrating the in vivo immunogenicity of the minigene.

DNA minigenes, constructed as described in the previous Example, can also be confirmed as a vaccine in combination with a boosting agent using a prime boost protocol. The boosting agent can consist of recombinant protein (e.g., Barnett et al., *Aids Res. and Human Retroviruses* 14, Supplement 3:S299-S309, 1998) or recombinant vaccinia, for example, expressing a minigene or DNA encoding the complete protein of interest (see, e.g., Hanke et al., *Vaccine* 16:439-445, 1998; Sedegah et al., Proc. Natl. Acad. Sci USA 95:7648-53, 1998; Hanke and McMichael, *Immunol. Letters* 66:177-181, 1999; and Robinson et al., *Nature Med.* 5:526-34, 1999).

For example, the efficacy of the DNA minigene used in a prime boost protocol is initially evaluated in transgenic mice. In this example, A2.1/K$^b$ transgenic mice are immunized IM with 100 μg of a DNA minigene encoding the immunogenic peptides including at least one HLA-A2 supermotif-bearing peptide. After an incubation period (ranging from 3-9 weeks), the mice are boosted IP with 10$^7$ pfu/mouse of a recombinant vaccinia virus expressing the same sequence encoded by the DNA minigene. Control mice are immunized with 100 μg of DNA or recombinant vaccinia without the minigene sequence, or with DNA encoding the minigene, but without the vaccinia boost. After an additional incubation period of two weeks, splenocytes from the mice are immediately assayed for peptide-specific activity in an ELISPOT assay. Additionally, splenocytes are stimulated in vitro with the A2-restricted peptide epitopes encoded in the minigene and recombinant vaccinia, then assayed for peptide-specific activity in an alpha, beta and/or gamma IFN ELISA.

It is found that the minigene utilized in a prime-boost protocol elicits greater immune responses toward the HLA-A2 supermotif peptides than with DNA alone. Such an analysis can also be performed using HLA-A11 or HLA-B7 transgenic mouse models to assess CTL induction by HLA-A3 or HLA-B7 motif or supermotif epitopes. The use of prime boost protocols in humans is described below in the Example entitled "Induction of CTL Responses Using a Prime Boost Protocol."

Example 24

Peptide Compositions for Prophylactic Uses

Vaccine compositions of the present invention can be used to prevent 98P4B6 expression in persons who are at risk for tumors that bear this antigen. For example, a polyepitopic peptide epitope composition (or a nucleic acid comprising the same) containing multiple CTL and HTL epitopes such as those selected in the above Examples, which are also selected to target greater than 80% of the population, is administered to individuals at risk for a 98P4B6-associated tumor.

For example, a peptide-based composition is provided as a single polypeptide that encompasses multiple epitopes. The vaccine is typically administered in a physiological solution that comprises an adjuvant, such as Incomplete Freunds Adjuvant. The dose of peptide for the initial immunization is from about 1 to about 50,000 μg, generally 100-5,000 μg, for a 70 kg patient. The initial administration of vaccine is followed by booster dosages at 4 weeks followed by evaluation of the magnitude of the immune response in the patient, by techniques that determine the presence of epitope-specific CTL populations in a PBMC sample. Additional booster doses are administered as required. The composition is found to be both safe and efficacious as a prophylaxis against 98P4B6-associated disease.

Alternatively, a composition typically comprising transfecting agents is used for the administration of a nucleic acid-based vaccine in accordance with methodologies known in the art and disclosed herein.

Example 25

Polyepitopic Vaccine Compositions Derived from Native 98P4B6 Sequences

A native 98P4B6 polyprotein sequence is analyzed, preferably using computer algorithms defined for each class I and/or class II supermotif or motif, to identify "relatively short" regions of the polyprotein that comprise multiple epitopes. The "relatively short" regions are preferably less in length than an entire native antigen. This relatively short sequence that contains multiple distinct or overlapping, "nested" epitopes can be used to generate a minigene construct. The construct is engineered to express the peptide, which corresponds to the native protein sequence. The "relatively short" peptide is generally less than 250 amino acids in length, often less than 100 amino acids in length, preferably less than 75 amino acids in length, and more preferably less than 50 amino acids in length. The protein sequence of the vaccine composition is selected because it has maximal number of epitopes contained within the sequence, i.e., it has a high concentration of epitopes. As noted herein, epitope motifs may be nested or overlapping (i.e., frame shifted relative to one another). For example, with overlapping epitopes, two 9-mer epitopes and one 1 mer epitope can be present in a 10 amino acid peptide. Such a vaccine composition is administered for therapeutic or prophylactic purposes.

The vaccine composition will include, for example, multiple CTL epitopes from 98P4B6 antigen and at least one HTL epitope. This polyepitopic native sequence is administered either as a peptide or as a nucleic acid sequence which encodes the peptide. Alternatively, an analog can be made of this native sequence, whereby one or more of the epitopes comprise substitutions that alter the cross-reactivity and/or binding affinity properties of the polyepitopic peptide.

The embodiment of this example provides for the possibility that an as yet undiscovered aspect of immune system processing will apply to the native nested sequence and thereby facilitate the production of therapeutic or prophylactic immune response-inducing vaccine compositions. Additionally, such an embodiment provides for the possibility of motif-bearing epitopes for an HLA makeup(s) that is presently unknown. Furthermore, this embodiment (excluding an analoged embodiment) directs the immune response to multiple peptide sequences that are actually present in native 98P4B6, thus avoiding the need to evaluate any junctional epitopes. Lastly, the embodiment provides an economy of scale when producing peptide or nucleic acid vaccine compositions.

Example 26

Polyepitopic Vaccine Compositions from Multiple Antigens

The 98P4B6 peptide epitopes of the present invention are used in conjunction with epitopes from other target tumor-associated antigens, to create a vaccine composition that is useful for the prevention or treatment of cancer that expresses 98P4B6 and such other antigens. For example, a vaccine composition can be provided as a single polypeptide that incorporates multiple epitopes from 98P4B6 as well as tumor-associated antigens that are often expressed with a target cancer associated with 98P4B6 expression, or can be administered as a composition comprising a cocktail of one or more discrete epitopes. Alternatively, the vaccine can be administered as a minigene construct or as dendritic cells which have been loaded with the peptide epitopes in vitro.

Example 27

Use of Peptides to Evaluate an Immune Response

Peptides of the invention may be used to analyze an immune response for the presence of specific antibodies, CTL or HTL directed to 98P4B6. Such an analysis can be performed in a manner described by Ogg et al., *Science* 279: 2103-2106, 1998. In this Example, peptides in accordance with the invention are used as a reagent for diagnostic or prognostic purposes, not as an immunogen.

In this example highly sensitive human leukocyte antigen tetrameric complexes ("tetramers") are used for a cross-sectional analysis of, for example, 98P4B6 HLA-A*0201-specific CTL frequencies from HLA A*0201-positive individuals at different stages of disease or following immunization comprising a 98P4B6 peptide containing an A*0201 motif. Tetrameric complexes are synthesized as described (Musey et al., *N. Engl. J. Med.* 337:1267, 1997). Briefly, purified HLA heavy chain (A*0201 in this example) and β2-microglobulin are synthesized by means of a prokaryotic expression system. The heavy chain is modified by deletion of the transmembrane-cytosolic tail and COOH-terminal addition of a sequence containing a BirA enzymatic biotinylation site. The heavy chain, β2-microglobulin, and peptide are refolded by dilution. The 45-kD refolded product is isolated by fast protein liquid chromatography and then biotinylated by BirA in the presence of biolin (Sigma, St. Louis, Mo.), adenosine 5' triphosphate and magnesium. Streptavidin-phycoerythrin conjugate is added in a 1:4 molar ratio, and the tetrameric product is concentrated to 1 mg/ml. The resulting product is referred to as tetramer-phycoerythrin.

For the analysis of patient blood samples, approximately one million PBMCs are centrifuged at 300 g for 5 minutes and resuspended in 50 µl of cold phosphate-buffered saline. Tricolor analysis is performed with the tetramer-phycoerythrin, along with anti-CD8-Tricolor, and anti-CD38. The PBMCs are incubated with tetramer and antibodies on ice for 30 to 60 min and then washed twice before formaldehyde fixation. Gates are applied to contain >99.98% of control samples. Controls for the tetramers include both A*0201-negative individuals and A*0201-positive non-diseased donors. The percentage of cells stained with the tetramer is then determined by flow cytometry. The results indicate the number of cells in the PBMC sample that contain epitope-restricted CTLs, thereby readily indicating the extent of immune response to the 98P4B6 epitope, and thus the status of exposure to 98P4B6, or exposure to a vaccine that elicits a protective or therapeutic response.

Example 28

Use of Peptide Epitopes to Evaluate Recall Responses

The peptide epitopes of the invention are used as reagents to evaluate T cell responses, such as acute or recall responses, in patients. Such an analysis may be performed on patients who have recovered from 98P4B6-associated disease or who have been vaccinated with a 98P4B6 vaccine.

For example, the class I restricted CTL response of persons who have been vaccinated may be analyzed. The vaccine may be any 98P4B6 vaccine. PBMC are collected from vaccinated individuals and HLA typed. Appropriate peptide epitopes of the invention that, optimally, bear supermotifs to provide cross-reactivity with multiple HLA supertype family members, are then used for analysis of samples derived from individuals who bear that HLA type.

PBMC from vaccinated individuals are separated on Ficoll-Histopaque density gradients (Sigma Chemical Co., St. Louis, Mo.), washed three times in HBSS (GIBCO Laboratories), resuspended in RPMI-1640 (GIBCO Laboratories) supplemented with L-glutamine (2 mM), penicillin (50 U/ml), streptomycin (50 µg/ml), and Hepes (10 mM) containing 10% heat-inactivated human AB serum (complete RPMI) and plated using microculture formats. A synthetic peptide comprising an epitope of the invention is added at 10 µg/ml to each well and HBV core 128-140 epitope is added at 1 µg/ml to each well as a source of T cell help during the first week of stimulation.

In the microculture format, $4 \times 10^5$ PBMC are stimulated with peptide in 8 replicate cultures in 96-well round bottom plate in 100 µl/well of complete RPMI. On days 3 and 10, 100 µl of complete RPMI and 20 U/ml final concentration of rIL-2 are added to each well. On day 7 the cultures are transferred into a 96-well flat-bottom plate and restimulated with peptide, rIL-2 and 105 irradiated (3,000 rad) autologous feeder cells. The cultures are tested for cytotoxic activity on day 14. A positive CTL response requires two or more of the eight replicate cultures to display greater than 10% specific $^{51}$Cr release, based on comparison with non-diseased control subjects as previously described (Rehermann, et al., *Nature Med.* 2:1104,1108, 1996; Rehermann et al., *J. Clin. Invest.* 97:1655-1665, 1996; and Rehermann et al. *J. Clin. Invest.* 98:1432-1440,1996).

Target cell lines are autologous and allogeneic EBV-transformed B-LCL that are either purchased from the American Society for Histocompatibility and Immunogenetics (ASH I, Boston, Mass.) or established from the pool of patients as described (Guilhot, et al. *J. Virol.* 66:2670-2678, 1992).

Cytotoxicity assays are performed in the following manner. Target cells consist of either allogeneic HLA-matched or autologous EBV-transformed B lymphoblastoid cell line that are incubated overnight with the synthetic peptide epitope of the invention at 10 µM, and labeled with 100 µCi of $^{51}$Cr (Amersham Corp., Arlington Heights, Ill.) for 1 hour after which they are washed four times with HBSS.

Cytolytic activity is determined in a standard 4-h, split well $^{51}$Cr release assay using U-bottomed 96 well plates containing 3,000 targets/well. Stimulated PBMC are tested at effector/target (E/T) ratios of 20-50:1 on day 14. Percent cytotoxicity is determined from the formula: 100×[(experimental release−spontaneous release)/maximum release−spontaneous release)]. Maximum release is determined by lysis of targets by detergent (2% Triton X-100; Sigma Chemical Co., St. Louis, Mo.). Spontaneous release is <25% of maximum release for all experiments.

The results of such an analysis indicate the extent to which HLA-restricted CTL populations have been stimulated by previous exposure to 98P4B6 or a 98P4B6 vaccine.

Similarly, Class II restricted HTL responses may also be analyzed. Purified PBMC are cultured in a 96-well flat bottom plate at a density of $1.5 \times 10^5$ cells/well and are stimulated with 10 µg/ml synthetic peptide of the invention, whole 98P4B6 antigen, or PHA. Cells are routinely plated in replicates of 4-6 wells for each condition. After seven days of culture, the medium is removed and replaced with fresh medium containing 10 U/ml IL-2. Two days later, 1 µCi $^3$H-thymidine is added to each well and incubation is continued for an additional 18 hours. Cellular DNA is then harvested on glass fiber mats and analyzed for $^3$H-thymidine incorporation. Antigen-specific T cell proliferation is calculated as the ratio of $^3$H-thymidine incorporation in the presence of antigen divided by the $^3$H-thymidine incorporation in the absence of antigen.

Example 29

Induction Of Specific CTL Response In Humans

A human clinical trial for an immunogenic composition comprising CTL and HTL epitopes of the invention is set up as an IND Phase I, dose escalation study and carried out as a randomized, double-blind, placebo-controlled trial. Such a trial is designed, for example, as follows:

A total of about 27 individuals are enrolled and divided into 3 groups:

Group I: 3 subjects are injected with placebo and 6 subjects are injected with 5 µg of peptide composition;

Group II: 3 subjects are injected with placebo and 6 subjects are injected with 50 µg peptide composition;

Group III: 3 subjects are injected with placebo and 6 subjects are injected with 500 µg of peptide composition.

After 4 weeks following the first injection, all subjects receive a booster inoculation at the same dosage.

The endpoints measured in this study relate to the safety and tolerability of the peptide composition as well as its immunogenicity. Cellular immune responses to the peptide composition are an index of the intrinsic activity of this the peptide composition, and can therefore be viewed as a measure of biological efficacy. The following summarize the clinical and laboratory data that relate to safety and efficacy endpoints.

Safety: The incidence of adverse events is monitored in the placebo and drug treatment group and assessed in terms of degree and reversibility.

Evaluation of Vaccine Efficacy: For evaluation of vaccine efficacy, subjects are bled before and after injection. Peripheral blood mononuclear cells are isolated from fresh heparinized blood by Ficoll-Hypaque density gradient centrifugation, aliquoted in freezing media and stored frozen. Samples are assayed for CTL and HTL activity.

The vaccine is found to be both safe and efficacious.

Example 30

Phase II Trials In Patients Expressing 98P4B6

Phase II trials are performed to study the effect of administering the CTL-HTL peptide compositions to patients having cancer that expresses 98P4B6. The main objectives of the trial are to determine an effective dose and regimen for inducing CTLs in cancer patients that express 98P4B6, to establish the safety of inducing a CTL and HTL response in these patients, and to see to what extent activation of CTLs improves the clinical picture of these patients, as manifested, e.g., by the reduction and/or shrinking of lesions. Such a study is designed, for example, as follows:

The studies are performed in multiple centers. The trial design is an open-label, uncontrolled, dose escalation protocol wherein the peptide composition is administered as a single dose followed six weeks later by a single booster shot of the same dose. The dosages are 50, 500 and 5,000 micrograms per injection. Drug-associated adverse effects (severity and reversibility) are recorded.

There are three patient groupings. The first group is injected with 50 micrograms of the peptide composition and the second and third groups with 500 and 5,000 micrograms of peptide composition, respectively. The patients within each group range in age from 21-65 and represent diverse ethnic backgrounds. All of them have a tumor that expresses 98P4B6.

Clinical manifestations or antigen-specific T-cell responses are monitored to assess the effects of administering the peptide compositions. The vaccine composition is found to be both safe and efficacious in the treatment of 98P4B6-associated disease.

Example 31

Induction of CTL Responses Using a Prime Boost Protocol

A prime boost protocol similar in its underlying principle to that used to confirm the efficacy of a DNA vaccine in transgenic mice, such as described above in the Example entitled "The Plasmid Construct and the Degree to Which It Induces Immunogenicity," can also be used for the administration of the vaccine to humans. Such a vaccine regimen can include an initial administration of, for example, naked DNA followed by a boost using recombinant virus encoding the vaccine, or recombinant protein/polypeptide or a peptide mixture administered in an adjuvant.

For example, the initial immunization may be performed using an expression vector, such as that constructed in the Example entitled "Construction of "Minigene" Multi-Epitope DNA Plasmids" in the form of naked nucleic acid administered IM (or SC or ID) in the amounts of 0.5-5 mg at multiple sites. The nucleic acid (0.1 to 1000 µg) can also be administered using a gene gun. Following an incubation period of 3-4 weeks, a booster dose is then administered. The booster can be recombinant fowlpox virus administered at a dose of 5-107 to 5×109 pfu. An alternative recombinant virus, such as an MVA, canarypox, adenovirus, or adeno-associated virus, can also be used for the booster, or the polyepitopic protein or a mixture of the peptides can be administered. For evaluation of vaccine efficacy, patient blood samples are obtained before immunization as well as at intervals following administration of the initial vaccine and booster doses of the vaccine. Peripheral blood mononuclear cells are isolated from fresh heparinized blood by Ficoll-Hypaque density gradient centrifugation, aliquoted in freezing media and stored frozen. Samples are assayed for CTL and HTL activity.

Analysis of the results indicates that a magnitude of response sufficient to achieve a therapeutic or protective immunity against 98P4B6 is generated.

Example 32

Administration of Vaccine Compositions Using Dendritic Cells (DC)

Vaccines comprising peptide epitopes of the invention can be administered using APCs, or "professional" APCs such as DC. In this example, peptide-pulsed DC are administered to a patient to stimulate a CTL response in vivo. In this method, dendritic cells are isolated, expanded, and pulsed with a vaccine comprising peptide CTL and HTL epitopes of the invention. The dendritic cells are infused back into the patient to elicit CTL and HTL responses in vivo. The induced CTL and HTL then destroy or facilitate destruction, respectively, of the target cells that bear the 98P4B6 protein from which the epitopes in the vaccine are derived.

For example, a cocktail of epitope-comprising peptides is administered ex vivo to PBMC, or isolated DC therefrom. A pharmaceutical to facilitate harvesting of DC can be used, such as Progenipoietin™ (Monsanto, St. Louis, Mo.) or GM-CSF/IL-4. After pulsing the DC with peptides, and prior to reinfusion into patients, the DC are washed to remove unbound peptides.

As appreciated clinically, and readily determined by one of skill based on clinical outcomes, the number of DC reinfused into the patient can vary (see, e.g., *Nature Med.* 4:328, 1998; *Nature Med.* 2:52, 1996 and *Prostate* 32:272, 1997). Although 2-50×10$^6$ DC per patient are typically administered, larger number of DC, such as 10$^7$ or 10$^8$ can also be provided. Such cell populations typically contain between 50-90% DC.

In some embodiments, peptide-loaded PBMC are injected into patients without purification of the DC. For example, PBMC generated after treatment with an agent such as Progenipoietin™ are injected into patients without purification of the DC. The total number of PBMC that are administered often ranges from 10$^8$ to 10$^{10}$. Generally, the cell doses injected into patients is based on the percentage of DC in the blood of each patient, as determined, for example, by immunofluorescence analysis with specific anti-DC antibodies. Thus, for example, if Progenipoietin™ mobilizes 2% DC in the peripheral blood of a given patient, and that patient is to receive 5×10$^6$ DC, then the patient will be injected with a total of 2.5×10$^8$ peptide-loaded PBMC. The percent DC mobilized by an agent such as Progenipoietin™ is typically estimated to be between 2-10%, but can vary as appreciated by one of skill in the art.

Ex vivo activation of CTL/HTL responses

Alternatively, ex vivo CTL or HTL responses to 98P4B6 antigens can be induced by incubating, in tissue culture, the patient's, or genetically compatible, CTL or HTL precursor cells together with a source of APC, such as DC, and immunogenic peptides. After an appropriate incubation time (typically about 7-28 days), in which the precursor cells are activated and expanded into effector cells, the cells are infused into the patient, where they will destroy (CTL) or facilitate destruction (HTL) of their specific target cells, i.e., tumor cells.

Example 33

An Alternative Method of Identifying and Confirming Motif-Bearing Peptides

Another method of identifying and confirming motif-bearing peptides is to elute them from cells bearing defined MHC molecules. For example, EBV transformed B cell lines used for tissue typing have been extensively characterized to determine which HLA molecules they express. In certain cases these cells express only a single type of HLA molecule. These cells can be transfected with nucleic acids that express the antigen of interest, e.g. 98P4B6. Peptides produced by endogenous antigen processing of peptides produced as a result of transfection will then bind to HLA molecules within the cell and be transported and displayed on the cell's surface. Peptides are then eluted from the HLA molecules by exposure to mild acid conditions and their amino acid sequence determined, e.g., by mass spectral analysis (e.g., Kubo et al., *J. Immunol.* 152:3913, 1994). Because the majority of peptides that bind a particular HLA molecule are motif-bearing, this is an alternative modality for obtaining the motif-bearing peptides correlated with the particular HLA molecule expressed on the cell.

Alternatively, cell lines that do not express endogenous HLA molecules can be transfected with an expression construct encoding a single HLA allele. These cells can then be used as described, i.e., they can then be transfected with nucleic acids that encode 98P4B6 to isolate peptides corresponding to 98P4B6 that have been presented on the cell surface. Peptides obtained from such an analysis will bear motif(s) that correspond to binding to the single HLA allele that is expressed in the cell.

As appreciated by one in the art, one can perform a similar analysis on a cell bearing more than one HLA allele and subsequently determine peptides specific for each HLA allele expressed. Moreover, one of skill would also recognize that means other than transfection, such as loading with a protein antigen, can be used to provide a source of antigen to the cell.

Example 34

Complementary Polynucleotides

Sequences complementary to the 98P4B6-encoding sequences, or any parts thereof, are used to detect, decrease, or inhibit expression of naturally occurring 98P4B6. Although use of oligonucleotides comprising from about 15 to 30 base pairs is described, essentially the same procedure is used with smaller or with larger sequence fragments. Appropriate oligonucleotides are designed using, e.g., OLIGO 4.06 software (National Biosciences) and the coding sequence of 98P4B6. To inhibit transcription, a complementary oligonucleotide is designed from the most unique 5' sequence and used to prevent promoter binding to the coding sequence. To inhibit translation, a complementary oligonucleotide is designed to prevent ribosomal binding to a 98P4B6-encoding transcript.

Example 35

Purification of Naturally-Occurring or Recombinant 98P4B6 Using 98P4B6-Specific Antibodies Naturally occurring or recombinant 98P4B6 is substantially purified by immunoaffinity chromatography using antibodies specific for 98P4B6. An immunoaffinity column is constructed by covalently coupling anti-98P4B6 antibody to an activated chromatographic resin, such as CNBr-activated SEPHAROSE (Amersham Pharmacia Biotech). After the coupling, the resin is blocked and washed according to the manufacturers instructions.

Media containing 98P4B6 are passed over the immunoaffinity column, and the column is washed under conditions that allow the preferential absorbance of 98P4B6 (e.g., high ionic strength buffers in the presence of detergent). The column is eluted under conditions that disrupt antibody/98P4B6 binding (e.g., a buffer of pH 2 to pH 3, or a high concentration of a chaotrope, such as urea or thiocyanate ion), and GCR.P is collected.

Example 36

Identification of Molecules Which Interact with 98P4B6

98P4B6, or biologically active fragments thereof, are labeled with 121 1 Bolton-Hunter reagent. (See, e.g., Bolton et al. (1973) Biochem. J. 133:529.) Candidate molecules previously arrayed in the wells of a multi-well plate are incubated with the labeled 98P4B6, washed, and any wells with labeled 98P4B6 complex are assayed. Data obtained using different concentrations of 98P4B6 are used to calculate values for the number, affinity, and association of 98P4B6 with the candidate molecules.

Example 37

In Vivo Assay for 98P4B6 Tumor Growth Promotion

The effect of the 98P4B6 protein on tumor cell growth is evaluated in vivo by gene overexpression in tumor-bearing mice. For example, prostate (PC3), lung (A427), stomach, ovarian (PA1) and uterus cell lines are engineered to express 98P4B6. SCID mice are injected subcutaneously on each flank with $1 \times 10^6$ of PC3, A427, PA1, or NIH-3T3 cells containing tkNeo empty vector or 98P4B6. At least two strategies may be used: (1) Constitutive 98P4B6 expression under regulation of a promoter such as a constitutive promoter obtained from the genomes of viruses such as polyoma virus, fowlpox virus (UK 2,211,504 published 5 Jul. 1989), adenovirus (such as Adenovirus 2), bovine papilloma virus, avian sarcoma virus, cytomegalovirus, a retrovirus, hepatitis-B virus, and Simian Virus 40 (SV40), or from heterologous mammalian promoters, e.g., the actin promoter or an immunoglobulin promoter, provided such promoters are compatible with the host cell systems, and (2) Regulated expression under control of an inducible vector system, such as ecdysone, tet, etc., provided such promoters are compatible with the host cell systems. Tumor volume is then monitored at the appearance of palpable tumors and followed over time to determine if 98P4B6-expressing cells grow at a faster rate and whether tumors produced by 98P4B6-expressing cells demonstrate characteristics of altered aggressiveness (e.g. enhanced metastasis, vascularization, reduced responsiveness to chemotherapeutic drugs).

Additionally, mice can be implanted with $1 \times 10^5$ of the same cells orthotopically to determine if 98P4B6 has an effect on local growth in the prostate or on the ability of the cells to metastasize, specifically to lungs, lymph nodes, and bone marrow.

The assay is also useful to determine the 98P4B6 inhibitory effect of candidate therapeutic compositions, such as for example, 98P4B6 intrabodies, 98P4B6 antisense molecules and ribozymes.

Example 38

98P4B6 Monoclonal Antibody-mediated Inhibition of Tumors In Vivo.

The significant expression of 98P4B6 in prostate, lung, stomach, ovary, and uterus cancer tissues, its restrictive expression in normal tissues, together with its expected cell surface expression makes 98P4B6 an excellent target for antibody therapy. Similarly, 98P4B6 is a target for T-cell based immunotherapy. Thus, the therapeutic efficacy of anti-98P4B6 mAbs in human prostate cancer xenograft mouse models is evaluated by using androgen-independent LAPC-4 and LAPC-9 xenografts (Craft, N., et al., Cancer Res, 1999. 59(19): p. 5030-6) and the androgen independent recombinant cell line PC3-98P4B6 (see, e.g., Kaighn, M. E., et al., Invest Urol, 1979. 17(1): p. 16-23). Similar approaches using patient derived xenografts or xenograft cell lines are used for cancers listed in Table I.

Antibody efficacy on tumor growth and metastasis formation is studied, e.g., in a mouse orthotopic prostate cancer xenograft models and mouse lung, uterus, or stomach xenograft models. The antibodies can be unconjugated, as discussed in this Example, or can be conjugated to a therapeutic modality, as appreciated in the art. Anti-98P4B6 mAbs inhibit formation of both the androgen-dependent LAPC-9 and androgen-independent PC3-98P4B6 tumor xenografts. Anti-98P4B6 mAbs also retard the growth of established orthotopic tumors and prolonged survival of tumor-bearing mice. These results indicate the utility of anti-98P4B6 mAbs in the treatment of local and advanced stages of cancer. (See, e.g., (Saffran, D., et al., PNAS 10:1073-1078).

Administration of the anti-98P4B6 mAbs can lead to retardation of established orthotopic tumor growth and inhibition of metastasis to distant sites, resulting in a significant prolongation in the survival of tumor-bearing mice. These studies indicate that 98P4B6 is an attractive target for immunotherapy and demonstrate the therapeutic potential of anti-98P4B6 mAbs for the treatment of local and metastatic cancer. This example demonstrates that unconjugated 98P4B6 monoclonal antibodies are effective to inhibit the growth of human prostate tumor xenografts, as well as lung, uterus, or stomach xenograft grown in SCID mice; accordingly a combination of such efficacious monoclonal antibodies is also effective.

Tumor Inhibition Using Multiple Unconjugated 98P4B6 mAbs
Materials and Methods
98P4B6 Monoclonal Antibodies:
Monoclonal antibodies are raised against 98P4B6 as described in Example 11 entitled "Generation of 98P4B6 Monoclonal Antibodies (mAbs)." The antibodies are characterized by ELISA, Western blot, FACS, and immunoprecipitation for their capacity to bind 98P4B6. Epitope mapping data for the anti-98P4B6 mAbs, as determined by ELISA and Western analysis, recognize epitopes on the 98P4B6 protein. Immunohistochemical analysis of cancer tissues and cells with these antibodies is performed.

The monoclonal antibodies are purified from ascites or hybridoma tissue culture supernatants by Protein-G Sepharose chromatography, dialyzed against PBS, filter sterilized, and stored at −20° C. Protein determinations are performed by a Bradford assay (Bio-Rad, Hercules, Calif.). A therapeutic monoclonal antibody or a cocktail comprising a mixture of individual monoclonal antibodies is prepared and used for the treatment of mice receiving subcutaneous or orthotopic injections of LAPC-9 tumor xenografts.

Cancer Xenografts and Cell Lines

The LAPC-9 xenograft, which expresses a wild-type androgen receptor and produces prostate-specific antigen (PSA), is passaged in 6- to 8-week-old male ICR-severe combined immunodeficient (SCID) mice (Taconic Farms) by s.c. trocar implant (Craft, N., et al., supra). The prostate (PC3), lung (A427), ovarian (PA1) carcinoma cell lines (American Type Culture Collection) are maintained in RPMI or DMEM supplemented with L-glutamine and 10% FBS.

PC3-98P4B6, A427-98P4B6, PA1-98P4B6 and 3T3-98P4B6 cell populations are generated by retroviral gene transfer as described in Hubert, R. S., et al., STEAP: a prostate-specific cell-surface antigen highly expressed in human prostate tumors. Proc Nat Acad Sci USA, 1999. 96(25): p. 14523-8. Anti-98P4B6 staining is detected by using an FITC-conjugated goat anti-mouse antibody (Southern Biotechnology Associates) followed by analysis on a Coulter Epics-XL flow cytometer.

Xenograft Mouse Models.

Subcutaneous (s.c.) tumors are generated by injection of $1 \times 10^6$ LAPC-9, PC3, PC3-98P4B6, A427, A427-98P4B6, PA1, PA1-98P4B6, 3T3 or 3T3-98P4B6 cells mixed at a 1:1 dilution with Matrigel (Collaborative Research) in the right flank of male SCID mice. To test antibody efficacy on tumor formation, i.p. antibody injections are started on the same day as tumor-cell injections. As a control, mice are injected with either purified mouse IgG (ICN) or PBS; or a purified monoclonal antibody that recognizes an irrelevant antigen not expressed in human cells. In preliminary studies, no difference is found between mouse IgG or PBS on tumor growth. Tumor sizes are determined by vernier caliper measurements, and the tumor volume is calculated as length x width x height. Mice with s.c. tumors greater than 1.5 cm in diameter are sacrificed. PSA levels are determined by using a PSA ELISA kit (Anogen, Mississauga, Ontario). Circulating levels of anti-98P4B6 mAbs are determined by a capture ELISA kit (Bethyl Laboratories, Montgomery, Tex.). (See, e.g., (Saffran, D., et al., PNAS 10:1073-1078).

Orthotopic injections are performed under anesthesia by using ketamine/xylazine. For prostate orthotopic studies, an incision is made through the abdominal muscles to expose the bladder and seminal vesicles, which then are delivered through the incision to expose the dorsal prostate. LAPC-9 or PC3 cells ($5 \times 10^5$) mixed with Matrigel are injected into each dorsal lobe in a 10μl volume. To monitor tumor growth, mice are bled on a weekly basis for determination of PSA levels. The mice are segregated into groups for the appropriate treatments, with anti-98P4B6 or control mAbs being injected i.p.

Anti-98P4B6 mAbs Inhibit Growth of 98P4B6-Expressing Xenograft-Cancer Tumors

The effect of anti-98P4B6 mAbs on tumor formation is tested by using LAPC-9 and PC3-98P4B6 orthotopic models. As compared with the s.c. tumor model, the orthotopic model, which requires injection of tumor cells directly in the mouse prostate, lung, or ovary, respectively, results in a local tumor growth, development of metastasis in distal sites, deterioration of mouse health, and subsequent death (Saffran, D., et al., PNAS supra; Fu, X., et al., Int J Cancer, 1992. 52(6): p. 987-90; Kubota, T., J Cell Biochem, 1994. 56(1): p. 4-8). The features make the orthotopic model more representative of human disease progression and allowed us to follow the therapeutic effect of mAbs on clinically relevant end points.

Accordingly, tumor cells are injected into the mouse prostate, lung, or ovary, and 2 days later, the mice are segregated into two groups and treated with either: a) 200-500μg, of anti-98P4B6 Ab, or b) PBS three times per week for two to five weeks.

A major advantage of the orthotopic cancer model is the ability to study the development of metastases. Formation of metastasis in mice bearing established orthotopic tumors is studies by IHC analysis on lung sections using an antibody against a prostate-specific cell-surface protein STEAP expressed at high levels in LAPC-9 xenografts (Hubert, R. S., et al., Proc Natl Acad Sci USA, 1999. 96(25): p. 14523-8).

Mice bearing established orthotopic LAPC-9 or PC3-98P4B6 tumors are administered 1000 μg injections of either anti-98P4B6 mAb or PBS over a 4-week period. Mice in both groups are allowed to establish a high tumor burden (PSA levels greater than 300 ng/ml for IAPC-9), to ensure a high frequency of metastasis formation in mouse lungs. Mice then are killed and their prostate and lungs are analyzed for the presence of tumor cells by IHC analysis.

These studies demonstrate a broad anti-tumor efficacy of anti-98P4B6 antibodies on initiation and progression of prostate cancer in xenograft mouse models. Anti-98P4B6 antibodies inhibit tumor formation of both androgen-dependent and androgen-independent tumors as well as retarding the growth of already established tumors and prolong the survival of treated mice. Moreover, anti-98P4B6 mAbs demonstrate a dramatic inhibitory effect on the spread of local prostate tumor to distal sites, even in the presence of a large tumor burden. Thus, anti-98P4B6 mAbs are efficacious on major clinically relevant end points (tumor growth), prolongation of survival, and health.

Example 39

Therapeutic and Diagnostic Use of Anti-98P4B6 Antibodies in Humans.

Anti-98P4B6 monoclonal antibodies are safely and effectively used for diagnostic, prophylactic, prognostic and/or therapeutic purposes in humans. Western blot and immunohistochemical analysis of cancer tissues and cancer xenografts with anti-98P4B6 mAb show strong extensive staining in carcinoma but significantly lower or undetectable levels in normal tissues. Detection of 98P4B6 in carcinoma and in metastatic disease demonstrates the usefulness of the mAb as a diagnostic and/or prognostic indicator. Anti-98P4B6 antibodies are therefore used in diagnostic applications such as immunohistochemistry of kidney biopsy specimens to detect cancer from suspect patients.

As determined by flow cytometry, anti-98P4B6 mAb specifically binds to carcinoma cells. Thus, anti-98P4B6 antibodies are used in diagnostic whole body imaging applications, such as radioimmunoscintigraphy and radioimmunotherapy, (see, e.g., Potamianos S., et. al. Anti-cancer Res 20(2A):925-948 (2000)) for the detection of localized and metastatic cancers that exhibit expression of 98P4B6. Shedding or release of an extracellular domain of 98P4B6 into the extracellular milieu, such as that seen for alkaline phosphodiesterase B10 (Meerson, N. R., Hepatology 27:563-568 (1998)), allows diagnostic detection of 98P4B6 by anti-98P4B6 antibodies in serum and/or urine samples from suspect patients.

Anti-98P4B6 antibodies that specifically bind 98P4B6 are used in therapeutic applications for the treatment of cancers that express 98P4B6. Anti-98P4B6 antibodies are used as an unconjugated modality and as conjugated form in which the antibodies are attached to one of various therapeutic or imaging modalities well known in the art, such as a prodrugs, enzymes or radioisotopes. In preclinical studies, unconjugated and conjugated anti-98P4B6 antibodies are tested for efficacy of tumor prevention and growth inhibition in the SCID mouse cancer xenograft models, e.g., kidney cancer models AGS-K3 and AGS-K6, (see, e.g., the Example entitled "98P4B6 Monoclonal Antbody-mediated Inhibition of Bladder and Lung Tumors In Vivo". Either conjugated and unconjugated anti-98P4B6 antibodies are used as a therapeutic modality in human clinical trials either alone or in combination with other treatments as described in following Examples.

Example 40

Human Clinical Trials for the Treatment and Diagnosis of Human Carcinomas through use of Human Anti-98P4B6 Antibodies In vivo Antibodies are used in accordance with the present invention which recognize an epitope on 98P4B6, and are used in the treatment of certain tumors such as those listed in Table I. Based upon a number of factors, including 98P4B6 expression levels, tumors such as those listed in Table I are presently preferred indications. In connection with each of these indications, three clinical approaches are successfully pursued.

I.) Adjunctive therapy: In adjunctive therapy, patients are treated with anti-98P4B6 antibodies in combination with a chemotherapeutic or antineoplastic agent and/or radiation therapy. Primary cancer targets, such as those listed in Table I, are treated under standard protocols by the addition anti-98P4B6 antibodies to standard first and second line therapy. Protocol designs address effectiveness as assessed by reduction in tumor mass as well as the ability to reduce usual doses of standard chemotherapy. These dosage reductions allow additional and/or prolonged therapy by reducing dose-related toxicity of the chemotherapeutic agent. Anti-98P4B6 antibodies are utilized in several adjunctive clinical trials in combination with the chemotherapeutic or antineoplastic agents adriamycin (advanced prostate carcinoma), cisplatin (advanced head and neck and lung carcinomas), taxol (breast cancer), and doxorubicin (preclinical).

II.) Monotherapy: In connection with the use of the anti-98P4B6 antibodies in monotherapy of tumors, the antibodies are administered to patients without a chemotherapeutic or antineoplastic agent. In one embodiment, monotherapy is conducted clinically in end stage cancer patients with extensive metastatic disease. Patients show some disease stabilization. Trials demonstrate an effect in refractory patients with cancerous tumors.

III.) Imaging Agent: Through binding a radionuclide (e.g., iodine or yttrium ($I^{131}$, $Y^{90}$) to anti-98P4B6 antibodies, the radiolabeled antibodies are utilized as a diagnostic and/or imaging agent. In such a role, the labeled antibodies localize to both solid tumors, as well as, metastatic lesions of cells expressing 98P4B6. In connection with the use of the anti-98P4B6 antibodies as imaging agents, the antibodies are used as an adjunct to surgical treatment of solid tumors, as both a pre-surgical screen as well as a post-operative follow-up to determine what tumor remains and/or returns. In one embodiment, a ($^{111}$In)-98P4B6 antibody is used as an imaging agent in a Phase I human clinical trial in patients having a carcinoma that expresses 98P4B6 (by analogy see, e.g., Divgi et al. J. Natl. Cancer Inst 83:97-104 (1991)). Patients are followed with standard anterior and posterior gamma camera. The results indicate that primary lesions and metastatic lesions are identified Dose and Route of Administration As appreciated by those of ordinary skill in the art, dosing considerations can be determined through comparison with the analogous products that are in the clinic. Thus, anti-98P4B6 antibodies can be administered with doses in the range of 5 to 400 mg/m$^2$, with the lower doses used, e.g., in connection with safety studies. The affinity of anti-98P4B6 antibodies relative to the affinity of a known antibody for its target is one parameter used by those of skill in the art for determining analogous dose regimens. Further, anti-98P4B6 antibodies that are fully human antibodies, as compared to the chimeric antibody, have slower clearance; accordingly, dosing in patients with such fully human anti-98P4B6 antibodies can be lower, perhaps in the range of 50 to 300 mg/m$^2$, and still remain efficacious. Dosing in mg/m$^2$, as opposed to the conventional measurement of dose in mg/kg, is a measurement based on surface area and is a convenient dosing measurement that is designed to include patients of all sizes from infants to adults.

Three distinct delivery approaches are useful for delivery of anti-98P4B6 antibodies. Conventional intravenous delivery is one standard delivery technique for many tumors. However, in connection with tumors in the peritoneal cavity, such as tumors of the ovaries, biliary duct, other ducts, and the like, intraperitoneal administration may prove favorable for obtaining high dose of antibody at the tumor and to also minimize antibody clearance. In a similar manner, certain solid tumors possess vasculature that is appropriate for regional perfusion. Regional perfusion allows for a high dose of antibody at the site of a tumor and minimizes short term clearance of the antibody.

Clinical Development Plan (CDP)

Overview: The CDP follows and develops treatments of anti-98P4B6 antibodies in connection with adjunctive therapy, monotherapy, and as an imaging agent. Trials initially demonstrate safety and thereafter confirm efficacy in repeat doses. Trails are open label comparing standard chemotherapy with standard therapy plus anti-98P4B6 antibodies. As will be appreciated, one criteria that can be utilized in connection with enrollment of patients is 98P4B6 expression levels in their tumors as determined by biopsy.

As with any protein or antibody infusion-based therapeutic, safety concerns are related primarily to (i) cytokine release syndrome, i.e., hypotension, fever, shaking, chills; (ii) the development of an immunogenic response to the material (i.e., development of human antibodies by the patient to the antibody therapeutic, or HAHA response); and, (iii) toxicity to normal cells that express 98P4B6. Standard tests and follow-up are utilized to monitor each of these safety concerns. Anti-98P4B6 antibodies are found to be safe upon human administration.

Example 41

Human Clinical Trial Adjunctive Therapy with Human Anti-98P4B6 Antibody and Chemotherapeutic Agent A phase I human clinical trial is initiated to assess the safety of six intravenous doses of a human anti-98P4B6 antibody in connection with the treatment of a solid tumor, e.g., a cancer of a tissue listed in Table I. In the study, the safety of single doses of anti-98P4B6 antibodies when utilized as an adjunctive therapy to an antineoplastic or chemotherapeutic agent as defined herein, such as, without limitation: cisplatin, topotecan, doxorubicin, adriamycin, taxol, or the like, is assessed. The trial design includes delivery of six single doses of an anti-98P4B6 antibody with dosage of antibody escalating from approximately about 25 mg/m$^2$ to about 275 mg/m$^2$ over the course of the treatment in accordance with the following schedule:

|  | Day 0 | Day 7 | Day 14 | Day 21 | Day 28 | Day 35 |
|---|---|---|---|---|---|---|
| mAb Dose | 25 mg/m$^2$ | 75 mg/m$^2$ | 125 mg/m$^2$ | 175 mg/m$^2$ | 225 mg/m$^2$ | 275 mg/m$^2$ |
| Chemotherapy (standard dose) | + | + | + | + | + | + |

Patients are closely followed for one-week following each administration of antibody and chemotherapy. In particular, patients are assessed for the safety concerns mentioned above: (i) cytokine release syndrome, i.e., hypotension, fever, shaking, chills; (ii) the development of an immunogenic response to the material (i.e., development of human antibodies by the patient to the human antibody therapeutic, or HAHA response); and, (iii) toxicity to normal cells that express 98P4B6. Standard tests and follow-up are utilized to monitor each of these safety concerns. Patients are also assessed for clinical outcome, and particularly reduction in tumor mass as evidenced by MRI or other imaging.

The anti-98P4B6 antibodies are demonstrated to be safe and efficacious, Phase II trials confirm the efficacy and refine optimum dosing.

Example 42

Human Clinical Trial: Monotherapy with Human Anti-98P4B6 Antibody

Anti-98P4B6 antibodies are safe in connection with the above-discussed adjunctive trial, a Phase II human clinical trial confirms the efficacy and optimum dosing for monotherapy. Such trial is accomplished, and entails the same safety and outcome analyses, to the above-described adjunctive trial with the exception being that patients do not receive chemotherapy concurrently with the receipt of doses of anti-98P4B6 antibodies.

Example 43

Human Clinical Trial: Diagnostic Imaging with Anti-98P4B6 Antibody

Once again, as the adjunctive therapy discussed above is safe within the safety criteria discussed above, a human clinical trial is conducted concerning the use of anti-98P4B6 antibodies as a diagnostic imaging agent. The protocol is designed in a substantially similar manner to those described in the art, such as in Divgi et al. *J. Natl. Cancer Inst.* 83:97-104 (1991). The antibodies are found to be both safe and efficacious when used as a diagnostic modality.

Example 44

Homology Comparison of 98P4B6 to Known Sequences

The 98P4B6 gene is homologous to a cloned and sequenced gene, namely human STAMP1 (gi 15418732) (Korkmaz, K. S et al, J. Biol. Chem. 2002, 277: 36689), showing 99% identity and 99% homology to that gene (FIG. 4). The 98P4B6 protein also shows 99% identity and 99% homology to another human six transmembrane epithelial antigen of prostate 2 (gi 23308593) (Walker, M. G et al, Genome Res. 1999, 9:1198; Porkka, K. P., Helenius, M. A. and Visakorpi, T, Lab. Invest. 2002, 82: 1573). The closest mouse homolog to 98P4B6 is six transmembrane epithelial antigen of prostate 2 (gi 28501136), with 97% identity and 99% homology. We have identified several variants of the 98P4B6 protein, including 4 splice variants and 3 SNPs (FIG. 11). The 98P4B6 v.1 protein consists of 454 amino acids, with calculated molecular weight of 52kDa, and pl of 8.7. It is a 6 transmembrane protein that can localize to the cell surface or possibly to the endoplasmic reticulum (Table VI). Several 98P4B6 variants, including v.1, v.5-8, v.13, v.14, v.21, v.25 share similar features, such protein motifs with functional significance, as well as structural commonalities such as multiple transmembrane domains. The 98P4B6 v.2 is a short protein with no known motifs.

Motif analysis revealed the presence of several known motifs, including oxido-reductase, homocysteine hydrolase and dudulin motifs. Variant v.7 and SNPs of this variant also carry an Ets motif, often associated with transcriptional activity.

Several oxidoreductases have been identified in mammalian cells, including the NADH/quinone oxidoreductase. This protein associate with the cell membrane and function as a proton/Na+ pump, which regulates the protein degradation of the tumor suppressor p53, and protects mammalian cells from oxidative stress, cytotoxicity, and mutages (Asher G, et al, Proc Natl Acad Sci USA. 2002, 99:13125; Jaiswal A K, Arch Biochem Biophys 2000, 375:62 Yano T, Mol Aspects Med 2002, 23;345). Homocysteine hydrolase is an enzyme known to catalyze the breakdown of S-adenosylhomocysteine to homocysteine and adenosine, ultimately regulating trans-methylation, therby regulating protein expression, cell cycle and proliferation (Turner M A et al. Cell Biochem Biophys 2000; 33:101; Zhang et al, J Biol Chem. 2001; 276:35867)

This information indicates that 98P4B6 plays a role in the cell growth of mammalian cells, regulate gene transcription and transport of electrons and small molecules. Accordingly, when 98P4B6 functions as a regulator of cell growth, tumor formation, or as a modulator of transcription involved in activating genes associated with inflammation, tumorigenesis, or proliferation, 98P4B6 is used for therapeutic, diagnostic, prognostic and/or preventative purposes. In addition, when a molecule, such as a variant or polymorphism of 98P4B6 is expressed in cancerous tissues, it is used for therapeutic, diagnostic, prognostic and/or preventative purposes.

Example 45

Phenotypic Effects of STEAP-2 Expression

Experiments regarding the expression of STEAP-2 protein having the amino acid sequence shown in FIG. 2 and encoded by a cDNA insert in a plasmid deposited with the American Type Culture Collection on 2 Jul. 1999 and assigned as ATCC Accession No. PTA-311. As deduced from the coding sequence, the open reading frame encodes 454 amino acids with 6 transmembrane domains. A summary of the characteristics associated with STEAP-2 protein is shown on FIG. 19.

This deposit was made under the provisions of the Budapest Treaty on the International Recognition of the Deposit of Microorganisms for the Purpose of Patent Procedure and the Regulations thereunder (Budapest Treaty). This assures maintenance of a viable culture of the deposit for 30 years from the date of deposit and for at least five (5) years after the most recent request for the furnishing of a sample of the deposit received by the depository. The deposits will be made available by ATCC under the terms of the Budapest Treaty, and subject to an agreement between Genentech, Inc. and ATCC, which assures that all restrictions imposed by the depositor on the availability to the public of the deposited material will be irrevocably removed upon the granting of the pertinent U.S. patent, assures permanent and unrestricted availability of the progeny of the culture of the deposit to the public upon issuance of the pertinent U.S. patent or upon laying open to the public of any U.S. or foreign patent application, whichever comes first, and assures availability of the progeny to one determined by the U.S. Commissioner of Patents and Trademarks to be entitled thereto according to 35 USC § 122 and the Commissioner's rules pursuant thereto (including 37 CFR § 1.14 with particular reference to 886 OG 638).

The assignee of the present application has agreed that if a culture of the materials on deposit should die or be lost or destroyed when cultivated under suitable conditions, the materials will be promptly replaced on notification with another of the same. Availability of the deposited material is not to be construed as a license to practice the invention in contravention of the rights granted under the authority of any government in accordance with its patent laws.

The data set forth in the present patent application provide an expression profile of the STEAP-2 protein that is predominantly specific for the prostate among normal tissues, for certain types of prostate tumors as well as other tumors. This evidence is based on detecting messenger RNA using Northern blotting. In keeping with standard practice in this industry, Northern blots are routinely used to assess gene expression, as it does not require the time consuming process of synthesizing the relevant protein, raising antibodies, assuring the specificity of the antibodies, required for Western blotting of proteins and the histological examination of tissues. Northern blotting offers a credible and efficient method of assessing RNA expression and expression levels.

This Example demonstrates that STEAP-2 protein is, indeed, produced. In summary, the experiments show that PC-3 cells and 3T3 cells which were modified to contain an expression system for STEAP-2 showed enhanced levels of tyrosine phosphorylation in general, and of phosphorylation of ERK protein in particular. The data also show that PC-3 cells that contain an expression system for STEAP-2 showed modified calcium flux, a modified response to paclitaxel, and a general inhibition of drug-induced apoptosis. These are effects exhibited at the protein level, thus these data alone are probative that the STEAP-2 protein exists.

Furthermore, although such phenotypic effects are protein-mediated, further evidence indicates that the STEAP-2 protein itself is the mediator of the effects. This evidence is obtained by utilizing a modified STEAP-2 protein. An expression system is stably introduced into PC3 and 3T3 cells which allows the expression of a modified form of STEAP-2, designated STEAP-2CFl, where "Fl" stands for flag. STEAP-2CFl is a STEAP-2 protein having a peptide extension, i.e., a Flag epitope that alters the physical conformation of this protein. The Flag epitope is a string 8 amino acids, often introduced at either the amino or carboxy termini of protein as a means of identifying and following a recombinant protein in engineered cells (Slootstra J W et al, Mol Divers 1997, 2:156). In most cases, the introduction of the Flag epitope at either termini of a protein has little effect on the natural function and location of that protein (Molloy SS et al, EMBO J 1994, 13:18). However, this is dependent on the characteristics of the protein being Flag tagged. Recent studies have shown that a Flag tag affects the function and conformation of select proteins such as the CLN3 protein (see, e.g., Haskell R E, et al. Mol Genet Metab 1999, 66:253). As with CLN3, introducing a Flag epitope tag to the C-terminus of STEAP-2 alters the physical conformation and properties of this protein. Altering the STEAP-2 protein with the C-Flag epitope resulted in a significant decrease in the effects otherwise observed, including phosphorylation of ERK and resistance to drug-induced cell death. The data indicate that it is the STEAP-2 protein that mediated these phenotypic effects. Finally, in vitro translation studies using rabbit reticulocyte lysate, showed that the STEAP-2 protein is translated and exhibits the expected molecular weight.

FIGS. 20 and 21 show the results obtained when PC-3 and 3T3 cells, respectively, were modified to contain the retroviral expression system pSRO encoding the indicated proteins, including STEAP-1, STEAP-2 and STEAP-2CFl, respectively. Gene-specific protein expression was driven from a long terminal repeat (LTR), and the Neomycin resistance gene was used for selection of mammalian cells that stably express the protein. PC-3 and 3T3 cells were transduced with the retrovirus, selected in the presence of G418 and cultured under conditions which permit expression of the STEAP-2 coding sequence. The cells were grown overnight in low concentrations of FBS (0.5-1% FBS) and were then stimulated with 10% FBS. The cells were lysed in RIPA buffer and quantitated for protein concentration. Whole cell lysates were separated by SDS-PAGE and analyzed by Western blotting using anti-phospho-ERK (Cell Signaling Inc.) or anti-phosphotyrosine (UBI) antibodies (FIGS. 20, 21, and 22). As shown on FIG. 20, as compared to untransformed PC-3 cells, cells modified to contain STEAP-2 contain enhanced amounts of phosphorylated tyrosine. Similar results from an analogous experiment on 3T3 cells are shown on page 3. In this latter experiment, the STEAP-2CFl expression system was also transfected into 3T3 cells, which cells were used as a control. As shown on FIG. 21, the enhanced phosphorylation found in the presence of native STEAP-2 was significantly reduced when the conformation of the protein was altered. These results thus show conclusively that the STEAP-2 protein was produced and mediated the above-described phenotypic effects.

FIG. 22 shows similar results, both in PC-3 and 3T3 cells where phosphorylation of ERK, specifically, is detected. The protocol is similar to that set forth in paragraph 5 above, except that rather than probing the gels with antibodies specific for phosphotyrosine the gels were probed both the anti-ERK and anti-phospho-ERK antibodies. As shown on FIG. 22, in the presence of 10% FBS, both PC-3 cells and 3T3 cells modified to express STEAP-2 showed phosphorylation of ERK which was not detectable in cells transformed to contain STEAP-2CFl. In contrast to control PC-3 cells which exhibit no background ERK phosphorylation, control 3T3-neo cells show low levels of endogenous ERK phosphorylation. Treatment with 10% FBS enhanced phosphorylation of ERK protein in cells expressing STEAP-2 relative to 3T3-neo cells, while no increase in ERK phosphorylation was observed in 3T3 cells expressing modified STEAP-2, i.e. STEAP-2 CFl.

Other effects on cellular metabolism in cells modified to contain a STEAP-2 expression system were also shown in our data. FIG. 23 shows that when cells with and without expression systems for STEAP-2 were measured for calcium flux in the presence of LPA, calcium flux was enhanced in the STEAP-2 containing cells. Using FACS analysis and commercially available indicators (Molecular Probes), parental cells and cells expressing STEAP-2 were compared for their ability to transport calcium. PC3-neo and PC3-STEAP-2 cells were loaded with calcium responsive indicators Fluo4 and Fura red, incubated in the presence or absence of calcium and LPA, and analyzed by flow cytometry. PC3 cells expressing a known calcium transporter, PC3-83P3H3 pCaT were used as positive control (Biochem Biophys Res Commun. 2001, 282:729). The table on FIG. 23 shows that STEAP-2 mediates calcium flux in response to LPA, and that the magnitude of calcium flux is comparable to that produced by a known calcium channel.

In addition, STEAP-2 expressing PC3 cells demonstrated increased sensitivity to agatoxin, a calcium channel blocker as compared to PC3-neo cells. These results indicate that STEAP-2 expression renders PC3 cells sensitive to treatment with the Ca++ channel inhibitors. Information derived from the above experiments provides a mechanism by which cancer cells are regulated. This is particularly relevant in the case of calcium, as calcium channel inhibitors have been reported to induce the death of certain cancer cells, including prostate cancer cell lines (see, e.g., Batra S, Popper LD, Hartley-Asp B. Prostate. 1991,19:299).

FIG. 24 shows that cells transfected with a STEAP-2 expression system have enhanced ability to survive exposure to paclitaxel. In order to determine the effect of STEAP-2 on survival, PC3 cells lacking or expressing STEAP-2 were treated with chemotherapeutic agents currently used in the clinic. Effect of treatment was evaluated by measuring cell proliferation using the Alamare blue assay (FIG. 23). While only 5.2% of PC3-neo cells were able to metabolize Alalmare Blue and proliferate in the presence of 5 µM paclitaxel, 44.8% of PC3-STEAP-2 cells survived under the same conditions. These results indicate that expression of STEAP-2 imparts resistance to paclitaxel. These findings have significant in vivo implications, as they indicate that STEAP-2 provides a growth advantage for prostate tumor cells in patients treated with common therapeutic agents.

A more detailed form of these results is shown on FIGS. 25 and 26. Results in these two pages demonstrate the mode of action by which STEAP-2 supports the survival of PC3 cells. In these studies, PC3 cells expressing or lacking STEAP-2 were treated with paclitaxel for 60 hours, and assayed for apoptosis using annexin V conjugated to FITC and propidium iodide staining. In apoptotic cells, the membrane phospholipid phosphatidylserine (PS) is translocated from the inner to the outer leaflet of the membrane, thereby exposing PS to the external cellular environment. PS is recognized by and binds to annexin V, providing scientists with a reliable means of identifying cells undergoing programmed cell death. Staining with propidium iodide identifies dead cells. FIG. 25 show that expression of STEAP-2 inhibits paclitaxel-mediated apoptosis by 45% relative to paclitaxel-treated PC3-neo cells. The protective effect of STEAP-2 is inhibited when STEAP-2 is modified by the presence of Flag at its C-terminus FIG. 26.

The publicly available literature contains several examples of prostate and other cancers that exhibit similar phenotypic characteristics as those observed in PC3 cells that express STEAP-2. In particular, clinical studies have reported transient tumor regression and/or only partial responses in patents treated with paclitaxel. For instance, only around 50% of prostate cancer patients entered in a single agent clinical trial of paclitaxel showed reduced PSA levels when treated with doses of paclitaxel that induced grade 3 and grade 4 toxicity; a much higher level of response would have been expected based on this dose level, thus this data indicates the development of paclitaxel resistance in prostate cancer patients (Beer T M et al, Ann Oncol 2001, 12:1273). A similar phenomenon of reduced responsiveness and progressive tumor recurrence was observed in other studies (see, e.g., Obasaju C, and Hudes G R. Hematol Oncol Clin North Am 2001, 15:525). In addition, inhibition of calcium flux in cells that endogenously express STEAP-2, such as LNCaP cells, induces their cell death (Skryma R et al, J Physiol. 2000, 527:71).

Thus, STEAP-2 protein is produced not only in the cells tested, but also in unmodified tumor cells or unmodified prostate cells where the presence of mRNA has been shown. The Northern blot data in the specification clearly show that the messenger RNA encoding STEAP-2 is produced in certain prostate and tumor cells. The 3T3 and PC-3 cells, which are themselves tumor cell lines, are clearly able to translate the messenger RNA into protein. Because it has been shown that there is no barrier to translation of the message in cells similar to those tumor and prostate cells in which the mRNA has been shown to be produced, it can properly be concluded that the protein itself can be detected in the unmodified tumor or prostate cells, given the fact that it is shown that mRNA is produced. This conclusion is also supported by the patterns of phenotypic changes seen in cells specifically modified to express STEAP-2, these changes comport with changes seen in cancer cells. Based on the above data, it is scientifically concluded that cells and tissues which produce mRNA encoding STEAP-2 also produce the protein itself.

Example 46

Identification and Confirmation of Potential Signal Transduction Pathways

Many mammalian proteins have been reported to interact with signaling molecules and to participate in regulating signaling pathways (J Neurochem. 2001; 76:217-223. Using immunoprecipitation and Western blotting techniques, proteins are identified that associate with 98P4B6 and mediate signaling events. Several pathways known to play a role in cancer biology can be regulated by 98P4B6, including phospholipid pathways such as P13K, AKT, etc, adhesion and migration pathways, including FAK, Rho, Rac-1, etc, as well as mitogenic/survival cascades such as ERK, p38, etc (Cell Growth Differ. 2000,11:279; J Biol Chem. 1999, 274:801; Oncogene. 2000,19:3003, J. Cell Biol. 1997,138:913.).

To confirm that 98P4B6 directly or indirectly activates known signal transduction pathways in cells, luciferase (luc) based transcriptional reporter assays are carried out in cells expressing individual genes. These transcriptional reporters contain consensus-binding sites for known transcription factors that lie downstream of well-characterized signal transduction pathways. The reporters and examples of these associated transcription factors, signal transduction pathways, and activation stimuli are listed below.

1. NFkB-luc, NFkB/Rel; Ik-kinase/SAPK; growth/apoptosis/stress
2. SRE-luc, SRF/TCF/ELK1; MAPK/SAPK; growth/differentiation
3. AP-1-luc, FOS/JUN; MAPK/SAPK/PKC; growth/apoptosis/stress
4. ARE-luc, androgen receptor; steroids/MAPK; growth/differentiation/apoptosis
5. p53-luc, p53; SAPK; growth/differentiation/apoptosis
6. CRE-luc, CREB/ATF2; PKA/p38; growth/apoptosis/stress Gene-mediated effects can be assayed in cells showing mRNA expression. Luciferase reporter plasmids can be introduced by lipid-mediated transfection (TFX-50, Promega). Luciferase activity, an indicator of relative transcriptional activity, is measured by incubation of cell extracts with luciferin substrate and luminescence of the reaction is monitored in a luminometer.

Signaling pathways activated by 98P4B6 are mapped and used for the identification and validation of therapeutic targets. When 98P4B6 is involved in cell signaling, it is used as target for diagnostic, prognostic, preventative and/or therapeutic purposes.

Example 47

98P4B6 Functions as a Proton or Small Molecule Transporter

Sequence and homology analysis of 98P4B6 indicate that the 98P4B6 may function as a transporter. To confirm that STEAP-1 functions as an ion channel, FACS analysis and fluorescent microscopy techniques are used (Gergely L, et al., Clin Diagn Lab Immunol. 1997; 4:70; Skryma R, et al., J Physiol. 2000, 527: 71). Using FACS analysis and commercially available indicators (Molecular Probes), parental cells and cells expressing 98P4B6 are compared for their ability to transport electrons, sodium, calcium; as well as other small molecules in cancer and normal cell lines. For example, PC3 and PC3-98P4B6 cells were loaded with calcium responsive indicators Fluo4 and Fura red, incubated in the presence or absence of calcium and lipophosphatidic acid (LPA), and analyzed by flow cytometry. Ion flux represents an important mechanism by which cancer cells are regulated. This is particularly true in the case of calcium, as calcium channel inhibitors have been reported to induce the death of certain cancer cells, including prostate cancer cell lines (Batra S, Popper L D, Hartley-Asp B. Prostate. 1991, 19: 299). Similar studies are conducted using sodium, potassium, pH, etc indicators.

Due to its homology to an oxidoreductase, 98P4B6 can participate in imparting drug resistance by mobilizing and transporting small molecules. The effect of 98P4B6 on small molecule transport is investigated using a modified MDR assay. Control and 98P4B6 expressing cells are loaded with a fluorescent small molecule such as calcein AM. Extrusion of calcein from the cell is measured by examining the supernatants for fluorescent compound. MDR-like activity is confirmed using MDR inhibitors.

When 98P4B6 functions as a transporter, it is used as target for diagnostic, prognostic, preventative and/or therapeutic purposes.

Example 48

Involvement in Tumor Progression

The 98P4B6 gene can contribute to the growth of cancer cells. The role of 98P4B6 in tumor growth is confirmed in a variety of primary and transfected cell lines including prostate as well as NIH 3T3 cells engineered to stably express 98P4B6. Parental cells lacking 98P4B6 and cells expressing 98P4B6 are evaluated for cell growth using a well-documented proliferation assay (Fraser S P, Grimes J A, Djamgoz M B. Prostate. 2000;44:61, Johnson D E, Ochieng J, Evans S L. Anticancer Drugs. 1996, 7:288).

To confirm the role of 98P4B6 in the transformation process, its effect in colony forming assays is investigated. Parental NIH-3T3 cells lacking 98P4B6 are compared to NIH-3T3 cells expressing 98P4B6, using a soft agar assay under stringent and more permissive conditions (Song Z. et al. Cancer Res. 2000;60:6730).

To confirm the role of 98P4B6 in invasion and metastasis of cancer cells, a well-established assay is used, e.g., a Transwell Insert System assay (Becton Dickinson) (Cancer Res. 1999; 59:6010). Control cells, including prostate and fibroblast cell lines lacking 98P4B6 are compared to cells expressing 98P4B6. Cells are loaded with the fluorescent dye, calcein, and plated in the top well of the Transwell insert coated with a basement membrane analog. Invasion is determined by fluorescence of cells in the lower chamber relative to the fluorescence of the entire cell population.

98P4B6 can also play a role in cell cycle and apoptosis. Parental cells and cells expressing 98P4B6 are compared for differences in cell cycle regulation using a well-established BrdU assay (Abdel-Malek Z A. J Cell Physiol. 1988, 136: 247). In short, cells are grown under both optimal (full serum) and limiting (low serum) conditions are labeled with BrdU and stained with anti-BrdU Ab and propidium iodide. Cells are analyzed for entry into the G1, S, and G2M phases of the cell cycle. Alternatively, the effect of stress on apoptosis is evaluated in control parental cells and cells expressing 98P4B6, including normal and tumor prostate cells. Engineered and parental cells are treated with various chemotherapeutic agents, such as etoposide, flutamide, etc, and protein synthesis inhibitors, such as cycloheximide. Cells are stained with annexin V-FITC and cell death is measured by FACS analysis. The modulation of cell death by 98P4B6 can play a critical role in regulating tumor progression and tumor load.

When 98P4B6 plays a role in cell growth, transformation, invasion or apoptosis, it is used as a target for diagnostic, prognostic, preventative and/or therapeutic purposes.

Example 49

Involvement in Angiogenesis

Angiogenesis or new capillary blood vessel formation is necessary for tumor growth (Hanahan D, Folkman J. Cell. 1996, 86:353; Folkman J. Endocrinology. 1998 139:441). Based on the effect of phsophodieseterase inhibitors on endothelial cells, 98P4B6 plays a role in angiogenesis (De-Fouw L et al, Microvasc Res 2001, 62:263). Several assays have been developed to measure angiogenesis in vitro and in vivo, such as the tissue culture assays endothelial cell tube formation and endothelial cell proliferation. Using these assays as well as in vitro neo-vascularization, the role of 98P4B6 in angiogenesis, enhancement or inhibition, is confirmed.

For example, endothelial cells engineered to express 98P4B6 are evaluated using tube formation and proliferation assays. The effect of 98P4B6 is also confirmed in animal models in vivo. For example, cells either expressing or lacking 98P4B6 are implanted subcutaneously in immunocompromised mice. Endothelial cell migration and angiogenesis are evaluated 5-15 days later using immunohistochemistry techniques. 98P4B6 affects angiogenesis, and it is used as a target for diagnostic, prognostic, preventative and/or therapeutic purposes.

Example 50

Regulation of Transcription

The localization of 98P4B6 and its similarity to hydrolases as well as its Ets motif (v.7) indicate that 98P4B6 is effectively used as a modulator of the transcriptional regulation of eukaryotic genes. Regulation of gene expression is confirmed, e.g., by studying gene expression in cells expressing or lacking 98P4B6. For this purpose, two types of experiments are performed.

In the first set of experiments, RNA from parental and 98P4B6-expressing cells are extracted and hybridized to commercially available gene arrays (Clontech) (Smid-Koopman E et al. Br J Cancer. 2000. 83:246). Resting cells as well as cells treated with FBS or androgen are compared. Differentially expressed genes are identified in accordance with procedures known in the art. The differentially expressed genes are then mapped to biological pathways (Chen K et al. Thyroid. 2001. 11:41.).

In the second set of experiments, specific transcriptional pathway activation is evaluated using commercially available (Stratagene) luciferase reporter constructs including: NFkB-luc, SRE-luc, ELK1-luc, ARE-luc, p53-luc, and CRE-luc. These transcriptional reporters contain consensus binding sites for known transcription factors that lie downstream of well-characterized signal transduction pathways, and represent a good tool to ascertain pathway activation and screen for positive and negative modulators of pathway activation.

Thus, 98P4B6 plays a role in gene regulation. When 98P4B6 is involved in gene regulation it is used as a target for diagnostic, prognostic, preventative and/or therapeutic purposes.

Example 51

Protein—Protein Association

Several 6TM proteins have been shown to interact with other proteins, thereby regulating signal transduction, gene transcription, transformation, and cell adhesion. Using immunoprecipitation techniques as well as two yeast hybrid systems, proteins are identified that associate with 98P4B6. Immunoprecipates from cells expressing 98P4B6 and cells lacking 98P4B6 are compared for specific protein-protein associations.

Studies are performed to confirm the extent of association of 98P4B6 with effector molecules, such as nuclear proteins, transcription factors, kinases, phsophates etc. Studies comparing 98P4B6 positive and 98P4B6 negative cells as well as studies comparing unstimulated/resting cells and cells treated with epithelial cell activators, such as cytokines, growth factors, androgen and anti-integrin Ab reveal unique interactions.

In addition, protein-protein interactions are confirmed using two yeast hybrid methodology (Curr Opin Chem Biol. 1999, 3:64). A vector carrying a library of proteins fused to the activation domain of a transcription factor is introduced into yeast expressing a 98P4B6-DNA-binding domain fusion protein and a reporter construct. Protein-protein interaction is detected by calorimetric reporter activity. Specific association with effector molecules and transcription factors directs one of skill to the mode of action of 98P4B6, and thus identifies therapeutic, prognostic, preventative and/or diagnostic targets for cancer. This and similar assays are also used to identify and screen for small molecules that interact with 98P4B6.

Thus it is found that 98P4B6 associates with proteins and small molecules. Accordingly, 98P4B6 and these proteins and small molecules are used for diagnostic, prognostic, preventative and/or therapeutic purposes.

Throughout this application, various website data content, publications, patent applications and patents are referenced. (Websites are referenced by their Uniform Resource Locator, or URL, addresses on the World Wide Web.) The disclosures of each of these references are hereby incorporated by reference herein in their entireties.

The present invention is not to be limited in scope by the embodiments disclosed herein, which are intended as single illustrations of individual aspects of the invention, and any that are functionally equivalent are within the scope of the invention. Various modifications to the models and methods of the invention, in addition to those described herein, will become apparent to those skilled in the art from the foregoing description and teachings, and are similarly intended to fall within the scope of the invention. Such modifications or other embodiments can be practiced without departing from the true scope and spirit of the invention.

TABLE I

Tissues that Express 98P4B6:

| | |
|---|---|
| a. | Malignant Tissues |
| a | Bladder |
| b. | Breast |
| c. | Cervix |
| d. | Colon |
| e. | Kidney |
| f. | Lung |
| g. | Ovary |
| h. | Pancreas |
| i. | Prostate |
| j. | Stomach |
| k. | Uterus |

TABLE II

Amino Acid Abbreviations

| SINGLE LETTER | THREE LETTER | FULL NAME |
|---|---|---|
| F | Phe | phenylalanine |
| L | Leu | leucine |
| S | Ser | serine |
| Y | Tyr | tyrosine |
| C | Cys | cysteine |
| W | Trp | tryptophan |
| P | Pro | proline |

TABLE II-continued

Amino Acid Abbreviations

| SINGLE LETTER | THREE LETTER | FULL NAME |
|---|---|---|
| H | His | histidine |
| Q | Gln | glutamine |
| R | Arg | arginine |
| I | Ile | isoleucine |
| M | Met | methionine |
| T | Thr | threonine |
| N | Asn | asparagine |
| K | Lys | lysine |
| V | Val | valine |
| A | Ala | alanine |
| D | Asp | aspartic acid |
| E | Glu | glutamic acid |
| G | Gly | glycine |

TABLE III

Amino Acid Substitution Matrix
Adapted from the GCG Software 9.0
BLOSUM62 amino acid substitution matrix
(block substitution matrix). The higher
the value, the more likely a substitution
is found in related, natural proteins.

| A | C | D | E | F | G | H | I | K | L | M | N | P | Q | R | S | T | V | W | Y | . |
|---|---|---|---|---|---|---|---|---|---|---|---|---|---|---|---|---|---|---|---|---|
| 4 | 0 | -2 | -1 | -2 | 0 | -2 | -1 | -1 | -1 | -1 | -2 | -1 | -1 | -1 | 1 | 0 | 0 | -3 | -2 | A |
|  | 9 | -3 | -4 | -2 | -3 | -3 | -1 | -3 | -1 | -1 | -3 | -3 | -3 | -3 | -1 | -1 | -1 | -2 | -2 | C |
|  |  | 6 | 2 | -3 | -1 | -1 | -3 | -1 | -4 | -3 | 1 | -1 | 0 | -2 | 0 | -1 | -3 | -4 | -3 | D |
|  |  |  | 5 | -3 | -2 | 0 | -3 | 1 | -3 | -2 | 0 | -1 | 2 | 0 | 0 | -1 | -2 | -3 | -2 | E |
|  |  |  |  | 6 | -3 | -1 | 0 | -3 | 0 | 0 | -3 | -4 | -3 | -3 | -2 | -2 | -1 | 1 | 3 | F |
|  |  |  |  |  | 6 | -2 | -4 | -2 | -4 | -3 | 0 | -2 | -2 | -2 | 0 | -2 | -3 | -2 | -3 | G |
|  |  |  |  |  |  | 8 | -3 | -1 | -3 | -2 | 1 | -2 | 0 | 0 | -1 | -2 | -3 | -2 | 2 | H |
|  |  |  |  |  |  |  | 4 | -3 | 2 | 1 | -3 | -3 | -3 | -3 | -2 | -1 | 3 | -3 | -1 | I |
|  |  |  |  |  |  |  |  | 5 | -2 | -1 | 0 | -1 | 1 | 2 | 0 | -1 | -2 | -3 | -2 | K |
|  |  |  |  |  |  |  |  |  | 4 | 2 | -3 | -3 | -2 | -2 | -2 | -1 | 1 | -2 | -1 | L |
|  |  |  |  |  |  |  |  |  |  | 5 | -2 | -2 | 0 | -1 | -1 | -1 | 1 | -1 | -1 | M |
|  |  |  |  |  |  |  |  |  |  |  | 6 | -2 | 0 | 0 | 1 | 0 | -3 | -4 | -2 | N |
|  |  |  |  |  |  |  |  |  |  |  |  | 7 | -1 | -2 | -1 | -1 | -2 | -4 | -3 | P |
|  |  |  |  |  |  |  |  |  |  |  |  |  | 5 | 1 | 0 | -1 | -2 | -2 | -1 | Q |
|  |  |  |  |  |  |  |  |  |  |  |  |  |  | 5 | -1 | -1 | -3 | -3 | -2 | R |
|  |  |  |  |  |  |  |  |  |  |  |  |  |  |  | 4 | 1 | -2 | -3 | -2 | S |
|  |  |  |  |  |  |  |  |  |  |  |  |  |  |  |  | 5 | 0 | -2 | -2 | T |
|  |  |  |  |  |  |  |  |  |  |  |  |  |  |  |  |  | 4 | -3 | -1 | V |
|  |  |  |  |  |  |  |  |  |  |  |  |  |  |  |  |  |  | 11 | 2 | W |
|  |  |  |  |  |  |  |  |  |  |  |  |  |  |  |  |  |  |  | 7 | Y |

TABLE IV

HLA Class I/II Motifs/Supermotifs

TABLE IV (A): HLA Class I Supermotifs/Motifs

| SUPERMOTIF | POSITION 2 (Primary Anchor) | POSITION 3 (Primary Anchor) | POSITION C Terminus (Primary Anchor) |
|---|---|---|---|
| A1 | T*ILVMS* | | FWY |
| A2 | LIVMATQ | | IVMATL |
| A3 | VSMATLI | | RK |
| A24 | YFWIVLMT | | FIYWLM |
| B7 | P | | VILFMWYA |
| B27 | RHK | | FYLWMIVA |
| 644 | ED | | FWYLIMVA |
| B58 | ATS | | FWYLIVMA |
| B62 | QLIVMP | | FWYMIVLA |
| MOTIFS | | | |
| A1 | TSM | | Y |
| A1 | | DEAS | Y |
| A2.1 | LMVQIAT | | VLIMAT |
| A3 | LMVISATFCGD | | KYRHFA |
| A11 | VTMLISAGNCDF | | KRYH |
| A24 | YFWM | | FLIW |
| A*3101 | MVTALIS | | RK |
| A*3301 | MVALFIST | | RK |
| A*6801 | AVTMSLI | | RK |
| B*0702 | P | | LMFWYAIV |
| B*3501 | P | | LMFWYIVA |
| B51 | P | | LIVFWYAM |
| B*5301 | P | | IMFWYALV |
| B*5401 | P | | ATIVLMFWY |

Bolded residues are preferred, italicized residues are less preferred: A peptide is considered motif-bearing if it has primary anchors at each primary anchor position for a motif or supermotif as specified in the above table.

TABLE IV (B): HLA Class II Supermotif

| 1 | 6 | 9 |
|---|---|---|
| W, F, Y, V, .I, L | A, V, I, L, P, C, S, T | A, V, I, L, C, S, T, M, Y |

TABLE IV (C): HLA Class II Motifs

| MOTIFS | | 1° anchor 1 | 2 | 3 | 4 | 5 | 1° anchor 6 | 7 | 8 | 9 |
|---|---|---|---|---|---|---|---|---|---|---|
| DR4 | preferred | FMY*LIVW* | M | T | W | I | VST*CPALIM* | MH | | MH |
| | deleterious | | | | | | | R | | WDE |
| DR1 | preferred | MF*LIVWY* | C | CH | PAMQ | CWD | VMAT*SPLIC* | M | | AVM |
| | deleterious | | | | FD | | | GDE | D | |
| DR7 | preferred | MF*LIVWY* | M | W | A | | IVMSA*CTPL* | M | | IV |
| | deleterious | | C | | G | | | GRD | N | G |
| DR3 | MOTIFS | 1° anchor 1 | 2 | 3 | 1° anchor 4 | 5 | 1° anchor 6 | | | |
| Motif a preferred | | LIVMFY | | | D | | KRH | | | |
| Motif b preferred | | LIVMFAY | | | DNQEST | | | | | |
| DR Supermotif | | MF*LIVWY* | | | | | VMSTA*CPLI* | | | |

Italicized residues indicate less preferred or "tolerated" residues

TABLE IV (D): HLA Class I Supermotifs

| SUPER-MOTIFS | POSITION: | 1 | 2 | 3 | 4 | 5 | 6 | 7 | 8 | C-terminus |
|---|---|---|---|---|---|---|---|---|---|---|
| A1 | | | 1° Anchor TI*LVMS* | | | | | | | 1° Anchor FWY |
| A2 | | | 1° Anchor LIVM*ATQ* | | | | | | | 1° Anchor LIVMAT |
| A3 | Preferred | DE (3/5); | 1° Anchor VSM*ATLI* | YFW (4/5) DE (4/5) | | | YFW (3/5) | YFW (4/5) | P (4/5) | 1° Anchor RK |
| | deleterious | P (5/5) | | | | | | | | |
| A24 | | | 1° Anchor YF*WIVLMT* | | | | | | | 1° Anchor FIY*WLM* |
| B7 | Preferred | FWY (5/5) | 1° Anchor P | FWY (4/5) | | | | | FWY (3/5) | 1° Anchor VILF*MWYA* |
| | deleterious | LIVM (3/5) DE (3/5); | | | | DE | G | QN | DE | |

TABLE IV-continued

HLA Class I/II Motifs/Supermotifs

|  |  |  |  |  |  |
|---|---|---|---|---|---|
|  | P (5/5);<br>G (4/5);<br>A (3/5);<br>QN (3/5) |  | (3/5) | (4/5) | (4/5) (4/5) |
| B27 |  | 1° Anchor<br>RHK |  |  | 1° Anchor<br>FYL*WMIVA* |
| B44 |  | 1° Anchor<br>E*D* |  |  | 1° Anchor<br>FWYLIMVA |
| B58 |  | 1° Anchor<br>ATS |  |  | 1° Anchor<br>FWY*LIVMA* |
| B62 |  | 1° Anchor<br>QL*IVMP* |  |  | 1° Anchor<br>FWY*MIVLA* |

Italicized residues indicate less preferred or "tolerated" residues

TABLE IV (E): HLA Class I Motifs

| POSITION | | 1 | 2 | 3 | 4 | 5 | 6 | 7 | 8 | 9 or C-terminus | C-terminus |
|---|---|---|---|---|---|---|---|---|---|---|---|
| A1 9-mer | preferred | GFYW | 1° Anchor STM | DEA | YFW |  | P | DEQN | YFW | 1° Anchor Y |  |
|  | deleterious | DE |  | RHKLIVMP | A | G | A |  |  |  |  |
| A1 9-mer | preferred | GRHK | ASTCLIVM | 1° Anchor DE*AS* | GSTC |  | ASTC | LIVM | DE | 1° Anchor Y |  |
|  | deleterious | A | RHKDEPYFW |  | DE | PQN | RHK | PG | GP |  |  |
| A1 10-mer | preferred | YFW | 1° Anchor STM | DEAQN | A | YFWQN | QNA | PASTC | GDE | P | 1° Anchor Y |
|  | deleterious | GP |  | RHKGLIVM | DE | RHK |  | RHKYFW | RHK | A |  |
| A1 10-mer | preferred | YFW | STCLIVM | 1° Anchor DE*AS* | A | YFW | G | PG | G | YFW | 1° Anchor Y |
|  | deleterious | RHK | RHKDEPYEW |  |  | P |  |  | PRHK | QN |  |
| A2.1 9-mer | preferred | YFW | 1° Anchor LM*IVQAT* | YFW | STC | YFW | RKH | A | P | 1° Anchor V*LIMAT* |  |
|  | deleterious | DEP |  | DERKH |  |  |  | DERKH |  |  |  |

| | POSI-TION: | 1 | 2 | 3 | 4 | 5 | 6 | 7 | 8 | 9 | C-Terminus |
|---|---|---|---|---|---|---|---|---|---|---|---|
| A2.1 10-mer | preferred | AYFW | 1° Anchor LM*IVQAT* | LVIM | G | P | *G* | RHK | FYW VIM |  | 1° Anchor V*LIMAT* |
|  | deleterious | DEP |  | DE | RKHA |  |  | DERKHRKH |  |  |  |
| A3 | preferred | RHK | 1° Anchor LMVISATFCGD | YFW | PRHKYFW | A | YFW |  | P | 1° Anchor KYR*HFA* |  |
|  | deleterious | DEP |  | DE |  |  |  |  |  |  |  |
| A11 | preferred | A | 1° Anchor VTLMISAGN*CDF* | YFW | YFW | A | YFW | YFW | P | 1° Anchor KR*YH* |  |
|  | deleterious | DEP |  |  |  |  |  | A | G |  |  |
| A24 9-mer | preferred | YFWRHK | 1° Anchor YFW*M* | DE | STC | QNP | DERHKG | YFW | YFW | 1° Anchor FLIW |  |
|  | deleterious | DEG |  |  | G |  |  |  | AQN |  |  |
| A24 10-mer | Preferred | YFW*IM* | 1° Anchor | GDE | P | YFWP | DE | P | QN | DEA | 1° Anchor FLIW |
|  | Deleterious |  |  | QN | RHK | A |  |  |  |  |  |
| A3101 | Preferred | RHK | 1° Anchor MVT*ALIS* | YFW | P | ADE | YFW | YFW | AP | 1° Anchor RK |  |
|  | Deleterious | DEP |  | DE |  |  | DE | DE | DE |  |  |
| A3301 | Preferred | GP | 1° Anchor MVAL*FIST* | YFW |  |  |  | AYEW |  | 1° Anchor RK |  |
|  | Deleterious |  |  | DE |  |  |  |  |  |  |  |
| A6801 | Preferred | YFWSTC | 1° Anchor AVT*MSLI* | DEG |  | YFWLIVM |  | YFW | P | 1° Anchor RK |  |
|  | deleterious | GP |  |  |  | RHK |  |  | A |  |  |
| B0702 | Preferred | RHKFWY | 1° Anchor P | RHK | DE | RHK | RHK | RHK | PA | 1° Anchor LMF*WYAIV* |  |
|  | deleterious | DEQNP |  | DEP |  | DE | GDE | QN | DE |  |  |

TABLE IV-continued

HLA Class I/II Motifs/Supermotifs

| | | | | | | | | | |
|---|---|---|---|---|---|---|---|---|---|
| B3501 | Preferred | FWYLIVM | 1° Anchor P | FWY | | | | FWY | 1° Anchor LMFWY*IV A* |

| | POSITION | 1 | 2 | 3 | 4 | 5 | 6 | 7 | 8 | 9 or C-terminus |
|---|---|---|---|---|---|---|---|---|---|---|
| A1 9-mer | preferred | GFYW | 1° Anchor STM | DEA | YFW | G | P | DEQN | YFW | 1° Anchor Y |
| | deleterious | DE | | RHKLIVMP | A | | A | | | |
| A1 9-mer | preferred | GRHK | ASTCLIVM | 1° Anchor DE*AS* | GSTC | PQN | ASTC | LIVM | DE | 1° Anchor Y |
| | deleterious | A | RHKDEPYFW | | DE | G | RHK | PG | GP | |
| | deleterious | AGP | | | | | G | | | |
| B51 | Preferred | LIVMFWY | 1° Anchor P | FWY | STC | FWY | G | G | FWY | 1° Anchor LIVF*WYA M* |
| | deleterious | AGPDER HKSTC | | | | DE | | DEQN | GDE | |
| B5301 | preferred | LIVMFWY | 1° Anchor P | FWY | STC | FWY | G | LIVMFWYFWY | DE | 1° Anchor IMFWY*A LV* |
| | deleterious | AGPQN | P | | | | | RHKQN | DE | |
| B5401 | preferred | FWY | 1° Anchor P | FWYLIVM | | LIVM | DE | ALIVM | FWYA P | 1° Anchor ATIV*LMF WY* |
| | deleterious | GPQNDE | | GDESTC | | RHKDE | | QNDGE | DE | |

TABLE IV (F): Summary of HLA-supertypes
Overall phenotypic frequencies of HLA-supertypes in different ethnic populations

| | Specificity | | Phenotypic frequency | | | | | |
|---|---|---|---|---|---|---|---|---|
| Supertype | Position 2 | C-Terminus | Caucasian | N.A. Black | Japanese | Chinese | Hispanic | Average |
| B7 | P | AILMVFWY | 43.2 | 55.1 | 57.1 | 43.0 | 49.3 | 49.5 |
| A3 | AILMVST | RK | 37.5 | 42.1 | 45.8 | 52.7 | 43.1 | 44.2 |
| A2 | AILMVT | AILMVT | 45.8 | 39.0 | 42.4 | 45.9 | 43.0 | 42.2 |
| A24 | YF (WIVLMT) | FI (YWLM) | 23.9 | 38.9 | 58.6 | 40.1 | 38.3 | 40.0 |
| B44 | E (D) | FWYLIMVA | 43.0 | 21.2 | 42.9 | 39.1 | 39.0 | 37.0 |
| A1 | TI (LVMS) | FWY | 47.1 | 16.1 | 21.8 | 14.7 | 26.3 | 25.2 |
| B27 | RHK | FYL (WMI) | 28.4 | 26.1 | 13.3 | 13.9 | 35.3 | 23.4 |
| B62 | QL (IVMP) | FWY (MIV) | 12.6 | 4.8 | 36.5 | 25.4 | 11.1 | 18.1 |
| B58 | ATS | FWY (LIV) | 10.0 | 25.1 | 1.6 | 9.0 | 5.9 | 10.3 |

TABLE IV (G):
Calculated population coverage afforded by different HLA-supertype combinations

| HLA-supertypes | Phenotypic frequency | | | | | |
|---|---|---|---|---|---|---|
| | Caucasian | N.A Blacks | Japanese | Chinese | Hispanic | Average |
| A2, A3 and B7 | 83.0 | 86.1 | 87.5 | 88.4 | 86.3 | 86.2 |
| A2, A3, B7, A24, B44 and A1 | 99.5 | 98.1 | 100.0 | 99.5 | 99.4 | 99.3 |
| A2, A3, B7, A24, B44, A1, B27, B62, and B 58 | 99.9 | 99.6 | 100.0 | 99.8 | 99.9 | 99.8 |

Motifs indicate the residues defining supertype specificites. The motifs incorporate residues determined on the basis of published data to be recognized by multiple alleles within the supertype. Residues within brackets are additional residues also predicted to be tolerated by multiple alleles within the supertype.

TABLE V

Frequently Occurring Motifs

| Name | avrg. % identity | Description | Potential Function |
|---|---|---|---|
| zf-C2H2 | 34% | Zinc finger, C2H2 type | Nucleic acid-binding protein functions as transcription factor, nuclear location probable |

TABLE V-continued

Frequently Occurring Motifs

| Name | avrg. % identity | Description | Potential Function |
|---|---|---|---|
| cytochrome_b_N | 68% | Cytochrome b(N-terminal)/b6/petB | membrane bound oxidase, generate superoxide |
| Ig | 19% | Immunoglobulin domain | domains are one hundred amino acids long and include a conserved intradomain disulfide bond. |
| WD40 | 18% | WD domain, G-beta repeat | tandem repeats of about 40 residues, each containing a Trp-Asp motif. Function in signal transduction and protein interaction |
| PDZ | 23% | PDZ domain | may function in targeting signaling molecules to sub-membranous sites |
| LRR | 28% | Leucine Rich Repeat | short sequence motifs involved in protein-protein interactions |
| Pkinase | 23% | Protein kinase domain | conserved catalytic core common to both serine/threonine and tyrosine protein kinases containing an ATP binding site and a catalytic site |
| PH | 16% | PH domain | pleckstrin homology involved in intracellular signaling or as constituents of the cytoskeleton |
| EGF | 34% | EGF-like domain | 30-40 amino-acid long found in the extracellular domain of membrane-bound proteins or in secreted proteins |
| Rvt | 49% | Reverse transcriptase (RNA-dependent DNA polymerase) | |
| Ank | 25% | Ank repeat | Cytoplasmic protein, associates integral membrane proteins to the cytoskeleton |
| Oxidored_q1 | 32% | NADH-Ubiquinone/plastoquinone (complex I), various chains | membrane associated. Involved in proton translocation across the membrane |
| Efhand | 24% | EF hand | calcium-binding domain, consists of a 12 residue loop flanked on both sides by a 12 residue alpha-helical domain |
| Rvp | 79% | Retroviral aspartyl protease | Aspartyl or acid proteases, centered on a catalytic aspartyl residue |
| Collagen | 42% | Collagen triple helix repeat (20 copies) | extracellular structural proteins involved in formation of connective tissue. The sequence consists of the G-X-Y and the polypeptide chains forms a triple helix. |
| Fn3 | 20% | Fibronectin type III domain | Located in the extracellular ligand-binding region of receptors and is about 200 amino acid residues long with two pairs of cysteines involved in disulfide bonds |
| 7tm_1 | 19% | 7 transmembrane receptor (rhodopsin family) | seven hydrophobic transmembrane regions, with the N-terminus located extracellularly while the C-terminus is cytoplasmic. Signal through G proteins |

TABLE VI

Motifs and Post-translational Modifications of 98P4B6 cAMP- and cGMP-dependent protein kinase phosphorylation site.

176-179 RKET (SEQ ID NO: 114)

Protein kinase C phosphorylation site.

235-237 SVK

Casein kinase II phosphorylation site.

9-12 SATD (SEQ ID NO: 115)
50-53 TVME (SEQ ID NO: 116)
130-133 SCTD (SEQ ID NO: 117)
172-175 SPEE (SEQ ID NO: 118)

TABLE VI-continued

Motifs and Post-translational Modifications of 98P4B6

N-myristoylation site.

14-19 GLSIST (SEQ ID NO: 119)

G-protein coupled receptors family 1 signature.

52-68 MESSVLLAMAFDRFVAV (SEQ ID NO: 120)

TABLE VII

Search Peptides v.1 aa1-454 (SEQ ID NO: 121)

9-mers, 10-mers and 15-mers
MESISMMGSP KSLSETCLPN GINGIKDARK VTVGVIGSGD FAKSLTIRLI RCGYHVVIGS
RNPKFASEFF PHVVDVTHHE DALTKTNIIF VAIHREHYTS LWDLRHLLVG KILIDVSNNM
RINQYPESNA EYLASLFPDS LTVKGFNVVS AWALQLGPKD ASRQVYICSN NIQARQQVIE
LARQLNFIPI DLGSLSSARE IENLPLRLFT LWRGPVVVAI SLATFFFLYS FVRDVIHPYA
RNQQSDFYKI PIEIVNKTLP IVAITLLSLV YLAGLLAAAY QLYYGTKYRR FPPWLETWLQ
CRKQLGLLSF FFANVHVAYS LCLPMRRSER YLFLNMAYQQ VHANIENSWN EEEVWRIEMY
TSFGIMSLGL LSLLAVTSIP SVSNALHWRE FSFIQSTLGY VALLISTFHV LIYGWKRAFE
EEYYRFYTPP NFVLALVLPS IVILDLLQLC RYPD v.2 aa1-45 (SEQ ID NO: 122)

9-mers, 10-mers, 15-mers
SGSPGLQALSL SLSSGFTPFS CLSLPSSWDY RCPPPCPADF FLYF v.5, (one aa diff at 211 and different c-terminal)
Part A 9-mers: aa203-219
NLPLRLFTFWRGPVVVA (SEQ ID NO: 123)

10-mers: aa202-220
ENLPLRLFTFWRGPVVVAI (SEQ ID NO: 124)

15-mers: aa197-225
SAREIENLPLRLFTFWRGPVVVAISLATF (SEQ ID NO: 125)

Part B 9-mers: aa388-419
WREFSFIQIFCSFADTQTELELEFVFLLTLLL (SEQ ID NO: 126)

10-mers: aa387-419
NWREFSFIQIFCSFADTQTELELEFVFLLTLLL (SEQ ID NO: 127)

15-mers: aa382-419
VSNALNWREFSFIQIFCSFADTQTELELEFVFLLTLLL (SEQ ID NO: 128)

v.6, (different from our original in 445-490)

9-mers; aa447-490 (SEQ ID NO: 129)
VLPSIVILGKIILFLPCISRKLKRIKKGWEKSQFLEEGIGGTIPHVSPERVTVM 10-mers: aa446-490 (SEQ ID NO: 130)
LVLPSIVILGKIILFLPCISRKLKRIKKGWEKSQFLEEGIGGTIPHVSPERVTVM 15-mers: aa441-490 (SEQ ID NO: 131)
NFVLALVLPSIVILGKIILFLPCISRKLKRIKKGWEKSQFLEEGIGGTTPHVSPERVTVM v.7, (deleting our original 340-394, 392-576 is different)
Part A 9-mers: aa334-350
FLNMAYQQSTLGYVALL (SEQ ID NO: 132)

10-mers: aa333-351
LFLNMAYQQSTLGYVALLI (SEQ ID NO: 133)

15-mers: aa328-355
RSERYLFLNMAYQQSTLGYVALLISTFHV (SEQ ID NO: 134)

Part B 9-mers: aa384576 (SEQ ID NO: 135)
PSIVILDLSVEVLASPAAAWKCLGANILRGGLSETVLPIEWQQDRKIPPLSTPPPPA
MWTEEAGATAEAQESGIRNKSSSSSQIPVVGVVTEDDEAQDSIDPPESPDRALKAANSWRNPV
LPHThGVGPLWEFLLRLLKSQAASGTLSLAFTSWSLGEFLGSGTWMKLETIILSKLTQEQKSKHCMF SLISGS 10-mers: aa383-576 (SEQ ID NO: 136)
LPSIVILDLSVEVLASPAAAWKCLGANILRGGLSEIVLPIEWQQDRKIPPLSTPPPPA
MWTEEAGATAEAQESGIRNKSSSSSQIPVVGVVTEDDEAQDSIDPPESPDRALKAANSWRNPV
LPHTNGVGPLWEFLLRLLKSQAASGTLSLAFTSWSLG EFLGSGTWMK LETIILSKLT QEQKSKHCMF
SLISGS

TABLE VII-continued

Search Peptides 15-mers: aa378-576 (SEQ ID NO: 137)
VLALVLPSIVILDLSVEVLASPAAAWKCLGANILRGGLSEIVLPIEWQQDRKIPPLSTPPPPA
MWTEEAGATAEAQESGIRNKSSSSQIPVVGVVTEDDEAQDSIDPPESPDRALKAANSWRNPV
LPHTNGVGPLWEFLLRLLKSQAASGTLSLAFTSWSLG EFLGSGTWMK LETIILSKLT QEQKSKHCMF
SLISGS v.8, SNP variant of v.6, one aa different at 475

9-mers: aa466-482
KSQFLEEGMGGTIPHVS (SEQ ID NO: 138)

10-mers: aa465-483
EKSQFLEEGMGGTIPHVSP (SEQ ID NO: 139)

15-mers: aa460-489
IKKGWEKSQFLEEGMGGTIPHVSPERVTV (SEQ ID NO: 140)

V13

9-mers: aa9-25
SPKSLSETFLPNGINGI (SEQ ID NO: 141)

10-mers: aa8-26
GSPKSLSETFLPNGINGIK (SEQ ID NO: 142)

15-mers: aa3-31
SISMMGSPKSLSETFLPNGINGIKDARKV (SEQ ID NO: 143)

v.14

9-mers: aa203-219
NLPLRLFTFWRGPVVVA (SEQ ID NO: 144)

10-mers: aa202-220
ENLPLRLFTFWRGPVVVAI (SEQ ID NO: 145)

15-mers: aa197-225
SAREIENLPLRLFTFWRGPVVVAISLATF (SEQ ID NO: 146)

V.21

9-mers 557-572
SKLTQEQKTKHCMFSLI (SEQ ID NO: 147)

10-mers 556-573
LSKLTQEQKTKHCMFSLIS (SEQ ID NO: 148)

15-mers 551-576
LETIILSKLTQEQKTKHCMFSLISGS (SEQ ID NO: 149)

V.25

9-mers aa 447-463
ILFLPCISQKLKRIKKG (SEQ ID NO: 150)

10-mers aa 446-464
IILFLPCISQKLKRIKKGW (SEQ ID NO: 151)

15-mers aa440-468
VILGKIILFLPCISQKLKRIKKGWEKSQF (SEQ ID NO: 152)

TABLE VIII

V1-HLA-A1-9mers-98P4B6
Each peptide is a portion of SEQ ID NO: 3;
each start position is specified, the
length of peptide is 9 amino acids, and
the end position for each peptide is the
start position plus eight.

| Start | Subsequence | Score |
|---|---|---|
| 443 | ILDLLQLCR | 25.000 |
| 129 | NAEYLASLF | 9.000 |
| 294 | WLETWLQCR | 9.000 |
| 113 | LIDVSNNMR | 5.000 |
| 200 | EIENLPLRL | 4.500 |
| 244 | QSDFYKIPI | 3.750 |
| 405 | ISTFHVLIY | 3.750 |
| 13 | LSETCLPNG | 2.700 |
| 221 | SLATFFFLY | 2.500 |
| 263 | AITLLSLVY | 2.500 |
| 276 | LAAAYQLYY | 2.500 |
| 419 | FEEEYYRFY | 2.250 |
| 155 | QLGPKDASR | 2.000 |
| 66 | ASEFFPHVV | 1.35 |
| 272 | LAGLLAAAY | 1.000 |
| 35 | VIGSGDFAK | 1.000 |
| 178 | VIELARQLN | 0.900 |
| 356 | RIEMYISFG | 0.900 |
| 418 | AFEEEYYRF | 0.900 |
| 319 | YSLCLPMRR | 0.750 |
| 43 | KSLTIRLIR | 0.750 |
| 327 | RSERYLFLN | 0.675 |
| 427 | YTPPNFVLA | 0.500 |
| 304 | QLGLLSFFF | 0.500 |
| 257 | KTLPIVAIT | 0.500 |
| 135 | SLFPDSLIV | 0.500 |
| 223 | ATFFFLYSF | 0.500 |
| 275 | LLAAAYQLY | 0.500 |
| 385 | ALNWREFSF | 0.500 |
| 219 | AISLATFFF | 0.500 |
| 16 | TCLPNGING | 0.500 |
| 90 | FVAIHREHY | 0.500 |
| 87 | NIIFVAIHR | 0.500 |
| 249 | KIPIEIVNK | 0.400 |
| 137 | FPDSLIVKG | 0.250 |
| 189 | PIDLGSLSS | 0.250 |
| 241 | RNQQSDFYK | 0.250 |
| 351 | EEEVWRIEM | 0.225 |
| 349 | WNEEEVWRI | 0.225 |
| 125 | YPESNAEYL | 0.225 |
| 420 | EEEYYRFYT | 0.225 |
| 388 | WREFSFIQS | 0.225 |
| 198 | AREIENLPL | 0.225 |
| 57 | VIGSRNPKF | 0.200 |
| 56 | VVIGSRNPK | 0.200 |
| 217 | VVAISLATF | 0.200 |
| 3 | SISMMGSPK | 0.200 |
| 417 | RAFEEEYYR | 0.200 |
| 436 | LVLPSIVIL | 0.200 |
| 377 | TSIPSVSNA | 0.150 |
| 158 | PKDASRQVY | 0.125 |
| 101 | LWDLRHLLV | 0.125 |
| 117 | SNNMRINQY | 0.125 |
| 392 | SFIQSTLGY | 0.125 |
| 202 | ENLPLRLFT | 0.125 |
| 330 | RYLFLNMAY | 0.125 |
| 38 | SGDFAKSLT | 0.125 |
| 98 | YTSLWDLRH | 0.125 |
| 406 | STFHVLIYG | 0.125 |
| 218 | VAISLATFF | 0.100 |
| 167 | ACSNNIQAR | 0.100 |
| 400 | YVALLISTF | 0.100 |
| 235 | VIHPYARNQ | 0.100 |
| 381 | SVSNALNWR | 0.100 |
| 22 | INGIKDARK | 0.100 |
| 21 | GINGIKDAR | 0.100 |
| 281 | QLYYGTKYR | 0.100 |
| 322 | CLPMRRSER | 0.100 |
| 411 | LIYGWKRAF | 0.100 |
| 191 | DLGSLSSAR | 0.100 |

TABLE VIII-continued

V1-HLA-A1-9mers-98P4B6
Each peptide is a portion of SEQ ID NO: 3; each start position is specified, the length of peptide is 9 amino acids, and the end position for each peptide is the start position plus eight.

| Start | Subsequence | Score |
|---|---|---|
| 409 | HVLIYGWKR | 0.100 |
| 344 | NIENSWNEE | 0.090 |
| 251 | PIEIVNKTL | 0.090 |
| 308 | LSFFFAMVH | 0.075 |
| 195 | LSSAREIEN | 0.075 |
| 116 | VSNNMRINQ | 0.075 |
| 280 | YQLYYGTKY | 0.075 |
| 220 | ISLATFFFL | 0.075 |
| 175 | RQQVIELAR | 0.075 |
| 127 | ESNAEYLAS | 0.075 |
| 432 | FVLALVLPS | 0.050 |
| 12 | SLSETCLPN | 0.050 |
| 106 | HLLVGKILI | 0.050 |
| 311 | FFAMVHVAY | 0.050 |
| 269 | LVYLAGLLA | 0.050 |
| 216 | VVVAISLAT | 0.050 |
| 124 | QYPESNAEY | 0.050 |
| 166 | YICSNNIQA | 0.050 |
| 258 | TLPIVAITL | 0.050 |
| 18 | LPNGINGIK | 0.050 |
| 435 | ALVLPSIVI | 0.050 |
| 25 | IKDARKVTV | 0.050 |
| 73 | VVDVTHHED | 0.050 |
| 222 | LATFFFLYS | 0.050 |
| 184 | QLNFIPIDL | 0.050 |
| 367 | SLGLLSLLA | 0.050 |
| 46 | TIRLIRCGY | 0.050 |
| 306 | GLLSFFFAM | 0.050 |
| 261 | IVAITLLSL | 0.050 |
| 203 | NLPLRLFTL | 0.050 |

TABLE VIII

V2-HLA-A1-9mers-98P4B6
Each peptide is a portion of SEQ ID NO: 5; each start position is specified, the length of peptide is 9 amino acids, and the end position for each peptide is the start position plus eight.

| Start | Subsequence | Score |
|---|---|---|
| 23 | LSLPSSWDY | 7.500 |
| 33 | CPPPCPADF | 0.500 |
| 36 | PCPADFFLY | 0.250 |
| 9 | LSLSLSSGF | 0.150 |
| 37 | CPADFFLYF | 0.125 |
| 17 | FTPFSCLSL | 0.125 |
| 24 | SLPSSWDYR | 0.100 |
| 12 | SLSSGFTPF | 0.100 |
| 14 | SSGFTPFSC | 0.075 |
| 5 | GLQALSLSL | 0.050 |
| 7 | QALSLSLSS | 0.050 |
| 13 | LSSGFTPFS | 0.030 |
| 2 | GSPGLQALS | 0.030 |
| 20 | FSCLSLPSS | 0.030 |
| 1 | SGSPGLQAL | 0.025 |
| 32 | RCPPPCPAD | 0.020 |
| 35 | PPCPADFFL | 0.013 |
| 3 | SPGLQALSL | 0.013 |
| 21 | SCLSLPSSW | 0.010 |
| 8 | ALSLSLSSG | 0.010 |
| 10 | SLSLSSGFT | 0.010 |
| 11 | LSLSSGFTP | 0.007 |
| 25 | LPSSWDYRC | 0.005 |
| 16 | GFTPFSCLS | 0.005 |
| 28 | SWDYRCPPP | 0.005 |
| 31 | YRCPPPCPA | 0.005 |
| 15 | SGFTPFSCL | 0.003 |
| 34 | PPPCPADFF | 0.003 |
| 6 | LQALSLSLS | 0.002 |
| 22 | CLSLPSSWD | 0.001 |
| 19 | PFSCLSLPS | 0.000 |
| 18 | TPFSCLSLP | 0.000 |
| 4 | PGLQALSLS | 0.000 |
| 27 | SSWDYRCPP | 0.000 |
| 26 | PSSWDYRCP | 0.000 |

TABLE VIII-continued

V2-HLA-A1-9mers-98P4B6
Each peptide is a portion of SEQ ID NO: 5; each start position is specified, the length of peptide is 9 amino acids, and the end position for each peptide is the start position plus eight.

| Start | Subsequence | Score |
|---|---|---|
| 29 | WDYRCPPPC | 0.000 |
| 30 | DYRCPPPCP | 0.000 |

TABLE VIII

V5A-HLA-A1-9mers-98P4B6
Each peptide is a portion of SEQ ID NO: 11; each start position is specified, the length of peptide is 9 amino acids, and the end position for each peptide is the start position plus eight

| Start | Subsequence | Score |
|---|---|---|
| 1 | NLPLRLFTF | 0.500 |
| 7 | FTFWRGPVV | 0.050 |
| 3 | PLRLFTFWR | 0.005 |
| 5 | RLFTFWRGP | 0.001 |
| 6 | LFTFWRGPV | 0.001 |
| 4 | LRLFTFWRG | 0.001 |
| 2 | LPLRLFTFW | 0.000 |
| 9 | FWRGPVVVA | 0.000 |
| 8 | TFWRGPVVV | 0.000 |

TABLE VIII

V5B-HLA-A1-9mers-98P4B6
Each peptide is a portion of SEQ ID NO: 11; each start position is specified, the length of peptide is 9 amino acids, and the end position for each peptide is the start position plus eight.

| Start | Subsequence | Score |
|---|---|---|
| 21 | ELEFVFLLT | 4.500 |
| 17 | QTELELEFT | 2.250 |
| 19 | ELELEFVFL | 1.800 |
| 1 | WREFSFIQI | 0.225 |
| 16 | TQTELELEF | 0.075 |
| 4 | FSFIQIFCS | 0.075 |
| 24 | FVFLLTLLL | 0.050 |
| 13 | FADTQTELE | 0.050 |
| 18 | TELELEFVF | 0.025 |
| 8 | QIFCSFADT | 0.020 |
| 10 | FCSFADTQT | 0.010 |

TABLE VIII-continued

V5B-HLA-A1-9mers-98P4B6
Each peptide is a portion of SEQ ID NO: 11; each start position is specified, the length of peptide is 9 amino acids, and the end position for each peptide is the start position plus eight.

| Start | Subsequence | Score |
|---|---|---|
| 6 | FIQIFCSFA | 0.010 |
| 2 | TEFSFIQIF | 0.005 |
| 5 | SFIQIFCSF | 0.005 |
| 15 | DTQTELELE | 0.003 |
| 20 | LELEFVFLL | 0.003 |
| 22 | LEFVFLLTL | 0.003 |
| 14 | ADTQTELEL | 0.003 |
| 3 | EFSFIQIFC | 0.003 |
| 11 | CSFADTQTE | 0.002 |
| 7 | IQIFCSFAD | 0.001 |
| 23 | EFVFLLTLL | 0.001 |
| 12 | SFADTQTEL | 0.001 |
| 9 | IFCSFADTQ | 0.001 |

TABLE VIII

V6-HLA-A1-9mers-98P4B6
Each peptide is a portion of SEQ ID NO: 13; each start position is specified, the length of peptide is 9 amino acids, and the end position for each peptide is the start position plus eight

| Start | Subsequence | Score |
|---|---|---|
| 34 | FLEEGIGGT | 0.900 |
| 12 | ILFLPCISR | 0.500 |
| 6 | VILGKIILF | 0.500 |
| 2 | LPSIVILGK | 0.250 |
| 42 | TIPHVSPER | 0.200 |
| 45 | HVSPERVTV | 0.200 |
| 13 | LFLPCISRK | 0.100 |
| 16 | PCISRKLKR | 0.050 |
| 1 | VLPSIVILG | 0.050 |
| 15 | LPCISRKLK | 0.050 |
| 5 | IVILGKIIL | 0.050 |
| 35 | LEEGIGGTI | 0.045 |
| 41 | GTIPHVSPE | 0.025 |
| 38 | GIGGTIPHV | 0.020 |
| 10 | KIILFLPCI | 0.020 |

TABLE VIII-continued

V6-HLA-A1-9mers-98P4B6
Each peptide is a portion of SEQ ID NO: 13;
each start position is specified, the
length of peptide is 9 amino acids, and the
end position for each peptide is the start
position plus eight

| Start | Subsequence | Score |
|---|---|---|
| 31 | KSQFLEEGI | 0.015 |
| 46 | VSPERVTVM | 0.015 |
| 37 | EGIGGTIPH | 0.013 |
| 4 | SIVILGKII | 0.010 |
| 14 | FLPCISRKL | 0.010 |
| 11 | IILFLPCIS | 0.010 |
| 19 | SRKLKRIKK | 0.005 |
| 7 | ILGKIILFL | 0.005 |
| 26 | KKGWEKSQF | 0.005 |
| 18 | ISRKLKRIK | 0.003 |
| 33 | QFLEEGIGG | 0.003 |
| 43 | IPHVSPERV | 0.003 |
| 9 | GKIILFLPC | 0.003 |
| 39 | IGGTIPHVS | 0.003 |
| 28 | GWEKSQFLE | 0.002 |
| 3 | PSIVILGKI | 0.002 |
| 32 | SQFLEEGIG | 0.002 |
| 23 | KRIKKGWEK | 0.001 |
| 17 | CISRKLKRI | 0.001 |
| 40 | GGTIPHVSP | 0.001 |
| 30 | EKSQFLEEG | 0.001 |
| 27 | KGWEKSQFL | 0.000 |
| 8 | LGKIILFLP | 0.000 |
| 24 | RIKKGWEKS | 0.000 |
| 21 | KLKRIKKGW | 0.000 |
| 36 | EEGIGGTIP | 0.000 |
| 44 | PHVSPERVT | 0.000 |
| 20 | RKLKRIKKG | 0.000 |
| 25 | IKKGWEKSQ | 0.000 |
| 29 | WEKSQFLEE | 0.000 |
| 22 | LKRIKKGWE | 0.000 |

TABLE VIII

V7A-HLA-A1-9mers-98P4B6
Each peptide is a portion of SEQ ID NO: 15;
each start position is specified, the
length of peptide is 9 amino acids, and
the end position for each peptide is the
start position plus eight.

| Start | Subsequence | Score |
|---|---|---|
| 5 | LSETFLPNG | 2.700 |
| 4 | SLSETFLPN | 0.050 |
| 7 | ETFLPNGIN | 0.025 |
| 8 | TFLPNGING | 0.025 |
| 9 | FLPNGINGI | 0.010 |
| 3 | KSLSETFLP | 0.007 |
| 1 | SPKSLSETF | 0.003 |
| 6 | SETFLPNGI | 0.001 |
| 2 | PKSLSETFL | 0.000 |

TABLE VIII

V7B-HLA-A1-9mers-98P4B6
Each peptide is a portion of SEQ ID NO: 15;
each start position is specified, the
length of peptide is 9 amino acids, and the
end position for each peptide is the start
position plus eight

| Start | Subsequence | Score |
|---|---|---|
| 5 | AYQQSTLGY | 0.125 |
| 9 | STLGYVALL | 0.050 |
| 8 | QSTLGYVAL | 0.030 |
| 1 | FLNMAYQQS | 0.010 |
| 4 | MAYQQSTLG | 0.010 |
| 3 | NMAYQQSTL | 0.005 |
| 7 | QQSTLGYVA | 0.003 |
| 2 | LNMAYQQST | 0.003 |
| 6 | YQQSTLGYV | 0.002 |

TABLE VIII

V7C-HLA-A1-9mers-98P4B6
Each peptide is a portion of SEQ ID NO: 15;
each start position is specified, the
length of peptide is 9 amino acids, and
the end position for each peptide is the
start position plus eight.

| Start | Subsequence | Score |
|---|---|---|
| 167 | KLETIILSK | 90.000 |
| 59 | WTEEAGATA | 4.500 |
| 13 | LASPAAAWK | 4.000 |
| 69 | AQESGIRNK | 2.700 |

TABLE VIII-continued

V7C-HLA-A1-9mers-98P4B6
Each peptide is a portion of SEQ ID NO: 15;
each start position is specified, the
length of peptide is 9 amino acids, and
the end position for each peptide is the
start position plus eight.

| Start | Subsequence | Score |
|---|---|---|
| 38 | PIEWQQDRK | 1.800 |
| 66 | TAEAQESGI | 0.900 |
| 9 | SVEVLASPA | 0.900 |
| 143 | ASGTLSLAF | 0.750 |
| 99 | SIDPPESPD | 0.500 |
| 51 | STPPPPAMW | 0.500 |
| 5 | ILDLSVEVL | 0.500 |
| 21 | KCLGANILR | 0.500 |
| 90 | VTEDDEAQD | 0.450 |
| 50 | LSTPPPPAM | 0.300 |
| 32 | LSEIVLPIE | 0.270 |
| 151 | FTSWSLGEF | 0.250 |
| 156 | LGEFLGSGT | 0.225 |
| 175 | KLTQEQKSK | 0.200 |
| 159 | FLGSGTWMK | 0.200 |
| 177 | TQEQKSKHC | 0.135 |
| 128 | GPLWEFLLR | 0.125 |
| 145 | GTLSLAFTS | 0.125 |
| 52 | TPPPPAMWT | 0.125 |
| 126 | GVGPLWEFL | 0.100 |
| 35 | IVLPIEWQQ | 0.100 |
| 100 | IDPPESPDR | 0.100 |
| 104 | ESPDRALKA | 0.075 |
| 78 | SSSSSQIPV | 0.075 |
| 154 | WSLGEFLGS | 0.075 |
| 131 | WEFLLRLLK | 0.050 |
| 22 | CLGANILRG | 0.050 |
| 68 | EAQESGIRN | 0.050 |
| 184 | HCMFSLISG | 0.050 |
| 7 | DLSVEVLAS | 0.050 |
| 170 | TIILSKLTQ | 0.050 |
| 2 | SIVILDLSV | 0.050 |
| 17 | AAAWKCLGA | 0.050 |
| 141 | QAASGTLSL | 0.050 |
| 123 | HTNGVGPLW | 0.050 |

TABLE VIII-continued

V7C-HLA-A1-9mers-98P4B6
Each peptide is a portion of SEQ ID NO: 15;
each start position is specified, the
length of peptide is 9 amino acids, and
the end position for each peptide is the
start position plus eight.

| Start | Subsequence | Score |
|---|---|---|
| 31 | GLSEIVLPI | 0.050 |
| 130 | LWEFLLRLL | 0.045 |
| 173 | LSKLTQEQK | 0.030 |
| 80 | SSSQIPVVG | 0.030 |
| 81 | SSQIPVVGV | 0.030 |
| 79 | SSSSQIPVV | 0.030 |
| 125 | NGVGPLWEF | 0.025 |
| 65 | ATAEAQESG | 0.025 |
| 37 | LPIEWQQDR | 0.025 |
| 92 | EDDEAQDSI | 0.025 |
| 169 | ETIILSKLT | 0.025 |
| 176 | LTQEQKSKH | 0.025 |
| 91 | TEDDEAQDS | 0.025 |
| 102 | PPESPDRAL | 0.022 |
| 103 | PESPDRALK | 0.020 |
| 11 | EVLASPAAA | 0.020 |
| 83 | QIPVVGVVT | 0.020 |
| 4 | VILDLSVEV | 0.200 |
| 12 | VLASPAAAW | 0.020 |
| 42 | QQDRKIPPL | 0.015 |
| 71 | ESGIRNKSS | 0.015 |
| 96 | AQDSIDPPE | 0.015 |
| 14 | ASPAAAWKC | 0.015 |
| 82 | SQIPVVGVV | 0.015 |
| 139 | KSQAASGTL | 0.015 |
| 147 | LSLAFTSWS | 0.015 |
| 29 | RGGLSEIVL | 0.013 |
| 105 | SPDRALKAA | 0.013 |
| 162 | SGTWMKLET | 0.013 |
| 160 | LGSGTWMKL | 0.013 |
| 127 | VGPLWEFLL | 0.013 |
| 146 | TLSLAFTSW | 0.010 |
| 88 | GVVTEDDEA | 0.010 |
| 142 | AASGTLSLA | 0.010 |
| 64 | GATAEAQES | 0.010 |

TABLE VIII-continued

V7C-HLA-A1-9mers-98P4B6
Each peptide is a portion of SEQ ID NO: 15;
each start position is specified, the
length of peptide is 9 amino acids, and
the end position for each peptide is the
start position plus eight.

| Start | Subsequence | Score |
|---|---|---|
| 119 | PVLPHTNGV | 0.010 |
| 46 | KIPPLSTPP | 0.010 |
| 62 | EAGATAEAQ | 0.010 |
| 109 | ALKAANSWR | 0.010 |
| 148 | SLAFTSWSL | 0.010 |
| 112 | AANSWRNPV | 0.010 |
| 149 | LAFTSWSLG | 0.010 |
| 34 | EIVLPIEWQ | 0.010 |
| 116 | WRNPVLPHT | 0.010 |
| 24 | GANILRGGL | 0.010 |
| 89 | VVTEDDEAQ | 0.010 |
| 155 | SLGEFLGSG | 0.010 |
| 120 | VLPHTNGVG | 0.010 |
| 181 | KSKHCMFSL | 0.008 |
| 113 | ANSWRNPVL | 0.005 |
| 67 | AEAQESGIR | 0.005 |
| 185 | CMFSLISGS | 0.005 |
| 144 | SGTLSLAFT | 0.005 |
| 93 | DDEAQDSID | 0.005 |
| 60 | TEEAGATAE | 0.005 |
| 8 | LSVEVLASP | 0.003 |
| 183 | KHCMFSLIS | 0.003 |
| 25 | ANILRGGLS | 0.003 |
| 165 | WMKLETIIL | 0.003 |
| 101 | DPPESPDRA | 0.003 |
| 5 | SPAAAWKCL | 0.003 |

TABLE IX

V1-HLA-A1-10mers-98P4B6
Each peptide is a portion of SEQ ID NO: 3;
each start position is specified, the
length of peptide is 10 amino acids, and
the end position for each peptide is the
start position plus nine.

| Start | Subsequence | Score |
|---|---|---|
| 178 | VIELARQLNF | 45.000 |
| 443 | ILDLLQLCRY | 25.000 |
| 294 | WLETWLQCRK | 18.000 |
| 135 | SLFPDSLIVK | 10.000 |
| 200 | EIENLPLRLF | 9.000 |
| 356 | RIEMYISFGI | 4.500 |
| 220 | ISLATFFFLY | 3.750 |
| 391 | FSFIQSTLGY | 3.750 |
| 76 | VTHHEDALTK | 2.500 |
| 404 | LISTFHVLIY | 2.500 |
| 262 | VAITLLSLVY | 2.500 |
| 275 | LLAAAYQLYY | 2.500 |
| 113 | LIDVSNNMRI | 2.500 |
| 351 | EEEVWRIEMY | 2.500 |
| 418 | AFEEEYYRFY | 2.250 |
| 123 | NQYPESNAEY | 1.500 |
| 13 | LSETCLPNGI | 1.350 |
| 137 | FPDSLIVKGF | 1.250 |
| 427 | YTPPNFVLAL | 1.250 |
| 257 | KTLPIVAITL | 1.250 |
| 271 | YLAGLLAAAY | 1.000 |
| 34 | GVIGSGDFAK | 1.000 |
| 321 | LCLPMRRSER | 1.000 |
| 198 | AREIENLPLR | 0.900 |
| 116 | VSNNMRINQY | 0.750 |
| 327 | RSERYLFLNM | 0.675 |
| 38 | SGDFAKSLTI | 0.625 |
| 384 | NALNWREFSF | 0.500 |
| 218 | VAISLATFFF | 0.500 |
| 274 | GLLAAAYQLY | 0.500 |
| 81 | DALTKTNIIF | 0.500 |
| 322 | CLPMRRSERY | 0.500 |
| 73 | VVDVTHHEDA | 0.500 |
| 232 | VRDVIHPYAR | 0.500 |
| 442 | VILDLLQLCR | 0.500 |
| 125 | YPESNAEYLA | 0.450 |
| 129 | NAEYLASLFP | 0.450 |

TABLE IX-continued

V1-HLA-A1-10mers-98P4B6
Each peptide is a portion of SEQ ID NO: 3;
each start position is specified, the
length of peptide is 10 amino acids, and
the end position for each peptide is the
start position plus nine.

| Start | Subsequence | Score |
|-------|-------------|-------|
| 21    | GINGIKDARK  | 0.400 |
| 2     | ESISMMGSPK  | 0.300 |
| 66    | ASEFFPHVVD  | 0.270 |
| 419   | FEEEYYRFTY  | 0.225 |
| 350   | NEEEVWRIEM  | 0.225 |
| 222   | LATFFFLYSF  | 0.200 |
| 56    | VVIGSRNPKF  | 0.200 |
| 281   | QLYYGTKYRR  | 0.200 |
| 55    | HVVIGSRNPK  | 0.200 |
| 278   | AAYQLYYGTK  | 0.200 |
| 417   | RAFEEEYYRF  | 0.200 |
| 216   | VVVAISLATF  | 0.200 |
| 248   | YKIPIEIVNK  | 0.200 |
| 317   | VAYSLCLPMR  | 0.200 |
| 17    | CLPNGINGIK  | 0.200 |
| 244   | QSDFYKIPIE  | 0.150 |
| 377   | TSIPSVSNAL  | 0.150 |
| 382   | VSNALNWREF  | 0.150 |
| 202   | ENLPLRLFTL  | 0.125 |
| 101   | LWDLRHLLVG  | 0.125 |
| 329   | ERYLFLNMAY  | 0.125 |
| 15    | ETCLPNGING  | 0.125 |
| 396   | STLGYVALLI  | 0.125 |
| 45    | LTIRLIRCGY  | 0.125 |
| 86    | TNIIFVAIHR  | 0.125 |
| 32    | TVGVIGSGDF  | 0.100 |
| 235   | VIHPYARNQQ  | 0.100 |
| 410   | VLIYGWKRAF  | 0.100 |
| 112   | ILIDVSNNMR  | 0.100 |
| 166   | YICSNNIQAR  | 0.100 |
| 16    | TCLPNGINGI  | 0.100 |
| 217   | VVAISLATFF  | 0.100 |
| 155   | QLGPKDASRQ  | 0.100 |
| 344   | NIENSWNEEE  | 0.090 |
| 139   | DSLIVKGFNV  | 0.075 |

TABLE IX-continued

V1-HLA-A1-10mers-98P4B6
Each peptide is a portion of SEQ ID NO: 3;
each start position is specified, the
length of peptide is 10 amino acids, and
the end position for each peptide is the
start position plus nine.

| Start | Subsequence | Score |
|-------|-------------|-------|
| 405   | ISTFHVLIYG  | 0.075 |
| 366   | MSLGLLSLLA  | 0.075 |
| 11    | KSLSETCLPN  | 0.075 |
| 134   | ASLFPDSLIV  | 0.075 |
| 43    | KSLTIRLIRC  | 0.075 |
| 303   | KQLGLLSFFF  | 0.075 |
| 361   | ISFGIMSLGL  | 0.075 |
| 304   | QLGLLSFFFA  | 0.050 |
| 107   | LLVGKILIDV  | 0.050 |
| 60    | SRNPKFASEF  | 0.050 |
| 269   | LVYLAGLLAA  | 0.050 |
| 434   | LALVLPSIVI  | 0.050 |
| 397   | TLGYVALLIS  | 0.050 |
| 364   | GIMSLGLLSL  | 0.050 |
| 401   | VALLISTFHV  | 0.050 |
| 147   | NVVSAWALQL  | 0.050 |
| 189   | PIDLGSLSSA  | 0.050 |
| 264   | ITLLSLVYLA  | 0.050 |
| 307   | LLSFFFAMVH  | 0.050 |
| 310   | FFFAMVHVAY  | 0.050 |
| 209   | FLTWRGPVVV  | 0.050 |
| 194   | SLSSAREIEN  | 0.050 |
| 240   | ARNQQSDFYK  | 0.050 |
| 298   | WLQCRKQLGL  | 0.050 |
| 440   | SIVILDLLQL  | 0.050 |
| 221   | SLATFFFLYS  | 0.050 |
| 436   | LVLPSIVILD  | 0.050 |
| 406   | STFHVLIYGW  | 0.050 |

TABLE IX

V2-HLA-A1-10mers-98P4B6
Each peptide is a portion of SEQ ID NO: 5;
each start position is specified, the
length of peptide is 10 amino acids, and
the end position for each peptide is the
start position plus nine.

| Start | Subsequence | Score |
|---|---|---|
| 32 | RCPPPCPADF | 2.000 |
| 23 | LSLPSSWDYR | 1.500 |
| 35 | PPCPADFFLY | 0.625 |
| 22 | CLSLPSSWDY | 0.500 |
| 33 | CPPPCPADFF | 0.250 |
| 11 | LSLSSGFTPF | 0.150 |
| 8 | ALSLSLSSGF | 0.100 |
| 13 | LSSGFTPFSC | 0.075 |
| 2 | GSPGLQALSL | 0.075 |
| 28 | SWDYRCPPPC | 0.050 |
| 1 | SGSPGLQALS | 0.050 |
| 36 | PCPADFFLYF | 0.050 |
| 16 | GFTPFSCLSL | 0.025 |
| 12 | SLSSGFTPFS | 0.020 |
| 24 | SLPSSWDYRC | 0.020 |
| 20 | FSCLSLPSSW | 0.015 |
| 14 | SSGFTPFSCL | 0.015 |
| 9 | LSLSLSSGFT | 0.015 |
| 18 | TPFSCLSLPS | 0.013 |
| 7 | QALSLSLSSG | 0.010 |
| 5 | GLQALSLSLS | 0.010 |
| 6 | LQALSLSLSS | 0.007 |
| 10 | SLSLSSGFTP | 0.005 |
| 15 | SGFTPFSCLS | 0.003 |
| 3 | SPGLQALSLS | 0.003 |
| 17 | FTPFSCLSLP | 0.003 |
| 34 | PPPCPADFFL | 0.001 |
| 4 | PGLQALSLSL | 0.001 |
| 31 | YRCPPPCPAD | 0.001 |
| 21 | SCLSLPSSWD | 0.001 |
| 27 | SSWDYRCPPP | 0.000 |
| 25 | LPSSWDYRCP | 0.000 |
| 26 | PSSWDYRCPP | 0.000 |
| 19 | PFSCLSLPSS | 0.000 |

TABLE IX-continued

V2-HLA-A1-10mers-98P4B6
Each peptide is a portion of SEQ ID NO: 5;
each start position is specified, the
length of peptide is 10 amino acids, and
the end position for each peptide is the
start position plus nine.

| Start | Subsequence | Score |
|---|---|---|
| 30 | DYRCPPPCPA | 0.000 |
| 29 | WDYRCPPPCP | 0.000 |

TABLE IX

V5A-HLA-A1-10mers-98P4B6
Each peptide is a portion of SEQ ID NO: 5;
each start position is specified, the
length of peptide is 10 amino acids, and
the end position for each peptide is the
start position plus nine.

| Start | Subsequence | Score |
|---|---|---|
| 1 | ENLPLRLFTF | 1.250 |
| 8 | FTFWRGPVVV | 0.050 |
| 3 | LPLRLFTFWR | 0.013 |
| 2 | NLPLRLFTFW | 0.010 |
| 6 | RLFTFWRGPV | 0.010 |
| 7 | LFTFWRGPVV | 0.001 |
| 4 | PLRLFTFWRG | 0.000 |
| 10 | FWRGPVVVAI | 0.000 |
| 5 | LRLFTFWRGP | 0.000 |
| 9 | TFWRGPVVVA | 0.000 |

TABLE IX

V5B-HLA-A1-10mers-98P4B6
Each peptide is a portion of SEQ ID NO: 11;
each start position is specified, the
length of peptide is 10 amino acids, and
the end position for each peptide is the
start position plus nine.

| Start | Subsequence | Score |
|---|---|---|
| 18 | QTELELEFVF | 112.500 |
| 20 | ELELEFVFLL | 4.500 |
| 22 | ELEFVFLLTL | 4.500 |
| 14 | FADTQTELEL | 2.500 |
| 16 | DTQTELELEF | 1.250 |
| 2 | WREFSFIQIF | 0.450 |
| 5 | FSFIQIFCSF | 0.150 |
| 12 | CSFADTQTEL | 0.015 |
| 9 | QIFCSFADTQ | 0.010 |

TABLE IX-continued

V5B-HLA-A1-10mers-98P4B6
Each peptide is a portion of SEQ ID NO: 11;
each start position is specified, the
length of peptide is 10 amino acids, and
the end position for each peptide is the
start position plus nine.

| Start | Subsequence | Score |
|---|---|---|
| 7 | FIQIFCSFAD | 0.005 |
| 8 | IQIFCSFADT | 0.003 |
| 21 | LELEFVFLLT | 0.003 |
| 4 | EFSFIQIFCS | 0.003 |
| 24 | EFVFLLTLLL | 0.003 |
| 3 | REFSFIQIFC | 0.003 |
| 17 | TQTELELEFV | 0.002 |
| 11 | FCSFADTQTE | 0.001 |
| 19 | TELELEFVFL | 0.001 |
| 6 | SFIQIFCSFA | 0.001 |
| 10 | IFCSFADTQT | 0.001 |
| 23 | LEFVFLLTLL | 0.001 |
| 1 | NWREFSFIQI | 0.000 |
| 15 | ADTQTELELE | 0.000 |
| 13 | SFADTQTELE | 0.000 |

TABLE IX

V6-HLA-A1-10mers-98P4B6
Each peptide is a portion of SEQ ID NO: 13;
each start position is specified, the
length of peptide is 10 amino acids, and
the end position for each peptide is the
start position plus nine.

| Start | Subsequence | Score |
|---|---|---|
| 42 | GTIPHVSPER | 5.000 |
| 2 | VLPSIVILGK | 1.000 |
| 35 | GLEEGIGGTI | 0.900 |
| 1 | LVLPSIVILG | 0.500 |
| 12 | IILFLPCISR | 0.500 |
| 6 | IVILGKIILF | 0.500 |
| 13 | ILFLPCISRK | 0.200 |
| 15 | FLPCISRKLK | 0.200 |
| 16 | LPCISRKLKR | 0.125 |
| 46 | HVSPERVTVM | 0.100 |
| 7 | VILGKIILFL | 0.050 |
| 5 | SIVILGKIIL | 0.050 |
| 18 | CISRKLKRIK | 0.020 |

TABLE IX-continued

V6-HLA-A1-10mers-98P4B6
Each peptide is a portion of SEQ ID NO: 13;
each start position is specified, the
length of peptide is 10 amino acids, and
the end position for each peptide is the
start position plus nine.

| Start | Subsequence | Score |
|---|---|---|
| 19 | ISRKLKRIKK | 0.015 |
| 32 | KSQFLEEGIG | 0.015 |
| 39 | GIGGTIPHVS | 0.010 |
| 43 | TIPHVSPERV | 0.010 |
| 11 | KIILFLPCIS | 0.010 |
| 33 | SQFLEEGIGG | 0.007 |
| 38 | EGIGGTIPHV | 0.005 |
| 14 | LFLPCISRKL | 0.005 |
| 36 | LEEGIGGTIP | 0.005 |
| 37 | EEGIGGTIPH | 0.003 |
| 3 | LPSIVILGKI | 0.003 |
| 44 | IPHVSPERVT | 0.003 |
| 29 | GWEKSQFLEE | 0.002 |
| 4 | PSIVILGKII | 0.002 |
| 9 | LGKIILGLPC | 0.001 |
| 23 | LKRIKKGWEK | 0.001 |
| 17 | PCISRKLKRI | 0.001 |
| 10 | GKIILFLPCI | 0.001 |
| 26 | IKKGWEKSQF | 0.001 |
| 34 | QFLEEGIGGT | 0.001 |
| 31 | EKSQFLEEGI | 0.001 |
| 27 | KKGWEKSQFL | 0.001 |
| 8 | ILGKIILFLP | 0.001 |
| 40 | IGGTIPHVSP | 0.001 |
| 41 | GGTIPHVSPE | 0.000 |
| 28 | KGWEKSQFLE | 0.000 |
| 25 | RIKKGWEKSQ | 0.000 |
| 45 | PHVSPERVTV | 0.000 |
| 21 | RKLKRIKKGW | 0.000 |
| 20 | SRKLKRIKKG | 0.000 |
| 30 | WEKSQFLEEG | 0.000 |
| 24 | KRIKKGWEKS | 0.000 |
| 22 | KLKRIKKGWE | 0.000 |

TABLE IX

V7A-HLA-A1-10mers-98P4B6
Each peptide is a portion of SEQ ID NO: 15; each start position is specified, the length of peptide is 10 amino acids, and the end position for each peptide is the start position plus nine.

| Start | Subsequence | Score |
|---|---|---|
| 6 | LSETFLPNGI | 1.350 |
| 10 | FLPNGINGIK | 0.200 |
| 8 | ETFLPNGING | 0.125 |
| 4 | KSLSETFLPN | 0.075 |
| 5 | SLSETFLPNG | 0.020 |
| 1 | GSPKSLSETF | 0.015 |
| 9 | TFLPNGINGI | 0.005 |
| 7 | SETFLPNGIN | 0.001 |
| 2 | SPKSLSETFL | 0.000 |
| 3 | PKSLSETFLP | 0.000 |

TABLE IX

V7B-HLA-A1-10mers-98P4B6
Each peptide is a portion of SEQ ID NO: 15; each start position is specified, the length of peptide is 10 amino acids, and the end position for each peptide is the start position plus nine.

| Start | Subsequence | Score |
|---|---|---|
| 5 | MAYQQSTLGY | 2.500 |
| 10 | STLGYVALLI | 0.125 |
| 9 | QSTLGYVALL | 0.030 |
| 2 | FLNMAYQQST | 0.010 |
| 4 | NMAYQQSTLG | 0.005 |
| 7 | YQQSTLGYVA | 0.003 |
| 8 | QQSTLGYVAL | 0.003 |
| 3 | LNMAYQQSTL | 0.003 |
| 6 | AYQQSTLGYV | 0.001 |
| 1 | LFLNMAYQQS | 0.001 |

TABLE IX

V7C-HLA-A1-10mers-98P4B6
Each peptide is a portion of SEQ ID NO: 15; each start position is specified, the length of peptide is 10 amino acids, and the end position for each peptide is the start position plus nine.

| Start | Subsequence | Score |
|---|---|---|
| 100 | SIDPPESPDR | 100.000 |
| 67 | TAEAQESGIR | 9.000 |

TABLE IX-continued

V7C-HLA-A1-10mers-98P4B6
Each peptide is a portion of SEQ ID NO: 15; each start position is specified, the length of peptide is 10 amino acids, and the end position for each peptide is the start position plus nine.

| Start | Subsequence | Score |
|---|---|---|
| 33 | LSEIVLPIEW | 6.750 |
| 131 | LWEFLLRLLK | 4.500 |
| 91 | VTEDDEAQDS | 2.250 |
| 10 | SVEVLASPAA | 1.800 |
| 52 | STPPPPAMWT | 1.250 |
| 6 | ILDLSVEVLA | 1.000 |
| 168 | KLETIILSKL | 0.900 |
| 103 | PPESPDRALK | 0.900 |
| 127 | GVGPLWEFLL | 0.500 |
| 143 | AASGTLSLAF | 0.500 |
| 13 | VLASPAAAWK | 0.400 |
| 51 | LSTPPPPAMW | 0.300 |
| 60 | WTEEAGATAE | 0.225 |
| 157 | LGEFLGSGTW | 0.225 |
| 69 | EAQESGIRNK | 0.200 |
| 97 | AQDSIDPPES | 0.150 |
| 70 | AQESGIRNKS | 0.135 |
| 178 | TQEQKSKHCM | 0.135 |
| 170 | ETIILSKLTQ | 0.125 |
| 128 | VGPLWEFLLR | 0.125 |
| 37 | VLPIEWQQDR | 0.100 |
| 14 | LASPAAAWKC | 0.100 |
| 61 | TEEAGATAEA | 0.090 |
| 39 | PIEWQQDRKI | 0.090 |
| 162 | GSGTWMKLET | 0.075 |
| 78 | KSSSSSQIPV | 0.075 |
| 160 | FLGSGTWMKL | 0.050 |
| 22 | KCLGANILRG | 0.050 |
| 167 | MKLETIILSK | 0.050 |
| 38 | LPIEWQQDRK | 0.050 |
| 80 | SSSSQIPVVG | 0.030 |
| 79 | SSSSSQIPVV | 0.030 |
| 83 | SQIPVVGVVT | 0.030 |
| 144 | ASGTLSLAFT | 0.030 |
| 81 | SSSQIPVVGV | 0.030 |

TABLE IX-continued

V7C-HLA-A1-10mers-98P4B6
Each peptide is a portion of SEQ ID NO: 15;
each start position is specified, the
length of peptide is 10 amino acids, and
the end position for each peptide is the
start position plus nine.

| Start | Subsequence | Score |
|---|---|---|
| 146 | GTLSLAFTSW | 0.025 |
| 66 | ATAEAQESGI | 0.025 |
| 152 | FTSWSLGEFL | 0.025 |
| 125 | TNGVGPLWEF | 0.025 |
| 92 | TEDDEAQDSI | 0.025 |
| 177 | LTQEQKSKHC | 0.025 |
| 21 | WKCLGANILR | 0.025 |
| 106 | SPDRALKAAN | 0.025 |
| 94 | DDEAQDSIDP | 0.022 |
| 12 | EVLASPAAAW | 0.020 |
| 4 | IVILDLSVEV | 0.020 |
| 173 | ILSKLTQEQK | 0.020 |
| 47 | KIPPLSTPPP | 0.020 |
| 113 | AANSWRNPVL | 0.020 |
| 72 | ESGIRNKSSS | 0.015 |
| 43 | QQDRKIPPLS | 0.015 |
| 15 | ASPAAAWKCL | 0.015 |
| 140 | KSQAASGTLS | 0.015 |
| 9 | LSVEVLASPA | 0.015 |
| 82 | SSQIPVVGVV | 0.015 |
| 155 | WSLGEFLGSG | 0.015 |
| 105 | ESPDRALKAA | 0.015 |
| 148 | LSLAFTSWSL | 0.015 |
| 124 | HTNGVGPLWE | 0.013 |
| 129 | GPLWEFLLRL | 0.013 |
| 31 | GGLSEIVLPI | 0.013 |
| 145 | SGTLSLAFTS | 0.013 |
| 185 | HCMFSLISGS | 0.010 |
| 149 | SLAFTSWSLG | 0.010 |
| 65 | GATAEAQESG | 0.010 |
| 112 | KAANSWRNPV | 0.010 |
| 142 | QAASGTLSLA | 0.010 |
| 25 | GANILRGGLS | 0.010 |
| 159 | EFLGSGTWMK | 0.010 |
| 23 | CLGANILRGG | 0.010 |

TABLE IX-continued

V7C-HLA-A1-10mers-98P4B6
Each peptide is a portion of SEQ ID NO: 15;
each start position is specified, the
length of peptide is 10 amino acids, and
the end position for each peptide is the
start position plus nine.

| Start | Subsequence | Score |
|---|---|---|
| 109 | RALKAANSWR | 0.010 |
| 176 | KLTQEQKSKH | 0.010 |
| 35 | EIVLPIEWQQ | 0.010 |
| 175 | SKLTQEQKSK | 0.010 |
| 18 | AAAWKCLGAN | 0.010 |
| 36 | IVLPIEWQQD | 0.010 |
| 5 | VILDLSVEVL | 0.010 |
| 172 | IILSKLTQEQ | 0.010 |
| 156 | SLGEFLGSGT | 0.010 |
| 120 | PVLPHTNGVG | 0.010 |
| 147 | TLSLAFTSWS | 0.010 |
| 89 | GVVTEDDEAQ | 0.010 |
| 153 | TSWSLGEFLG | 0.008 |
| 2 | PSIVILDLSV | 0.008 |
| 141 | SQAASGTLSL | 0.007 |
| 150 | LAFTSWSLGE | 0.005 |
| 17 | PAAAWKCLGA | 0.005 |
| 101 | IDPPESPDRA | 0.005 |
| 151 | AFTSWSLGEF | 0.005 |
| 117 | WRNPVLPHTN | 0.005 |
| 42 | WQQDRKIPPL | 0.003 |
| 104 | PESPDRALKA | 0.003 |
| 24 | LGANILRGGL | 0.003 |
| 119 | NPVLPHTNGV | 0.003 |
| 118 | RNPVLPHTNG | 0.003 |
| 102 | DPPESPDRAL | 0.003 |
| 53 | TPPPPAMWTE | 0.003 |
| 1 | LPSIVILDLS | 0.003 |

TABLE X

V1-HLA-A0201-9mers-98P4B6
Each peptide is a portion of SEQ ID NO: 3;
each start position is specified, the
length of peptide is 9 amino acids, and
the end position for each peptide is the
start position plus eight.

| Start | Subsequence | Score |
|---|---|---|
| 227 | FLYSFVRDV | 1789.612 |
| 402 | ALLISTFHV | 1492.586 |
| 307 | LLSFFFAMV | 853.681 |
| 306 | GLLSFFFAM | 769.748 |
| 100 | SLWDLRHLL | 726.962 |
| 333 | FLNMAYQQV | 479.909 |
| 140 | SLIVKGFNV | 403.402 |
| 203 | NLPLRLFTL | 284.974 |
| 210 | TLWRGPVVV | 236.685 |
| 65 | FASEFFPHV | 131.539 |
| 135 | SLFPDSLIV | 105.501 |
| 274 | GLLAAAYQL | 79.041 |
| 393 | FIQSTLGYV | 72.344 |
| 48 | RLIRCGYHV | 69.552 |
| 365 | IMSLGLLSL | 60.325 |
| 5 | SMMGSPKSL | 57.085 |
| 220 | ISLATFFFL | 53.163 |
| 271 | YLAGLLAAA | 52.561 |
| 265 | TLLSLVYLA | 42.278 |
| 433 | VLALVLPSI | 40.792 |
| 442 | VILDLLQLC | 40.518 |
| 112 | ILIDVSNNM | 34.627 |
| 360 | YISFGIMSL | 31.077 |
| 403 | LLISTFHVL | 28.290 |
| 369 | GLLSLLAVT | 26.001 |
| 17 | CLPNGINGI | 23.995 |
| 108 | LVGKILIDV | 23.795 |
| 264 | ITLLSLVYL | 23.608 |
| 258 | TLPIVAITL | 21.362 |
| 184 | QLNFIPIDL | 21.362 |
| 313 | AMVHVAYSL | 15.428 |
| 410 | VLIYGWKRA | 14.358 |
| 141 | LIVKGFNVV | 12.665 |
| 305 | LGLLSFFFA | 12.364 |
| 44 | SLTIRLIRC | 11.426 |

TABLE X-continued

V1-HLA-A0201-9mers-98P4B6
Each peptide is a portion of SEQ ID NO: 3;
each start position is specified, the
length of peptide is 9 amino acids, and
the end position for each peptide is the
start position plus eight.

| Start | Subsequence | Score |
|---|---|---|
| 436 | LVLPSIVIL | 11.087 |
| 397 | TLGYVALLI | 10.433 |
| 386 | LNWREFSFI | 10.042 |
| 180 | ELARQLNFI | 9.898 |
| 254 | IVNKTLPIV | 9.756 |
| 404 | LISTFHVLI | 9.267 |
| 357 | IEMYISFGI | 7.401 |
| 441 | IVILDLLQL | 7.309 |
| 261 | IVAITLLSL | 7.309 |
| 209 | FTLWRGPVV | 6.741 |
| 368 | LGLLSLLAV | 6.568 |
| 367 | SLGLLSLLA | 4.968 |
| 153 | ALQLGPKDA | 4.968 |
| 146 | FNVVSAWAL | 4.811 |
| 389 | REFSFIQST | 4.686 |
| 435 | ALVLPSIVI | 4.277 |
| 187 | FIPIDLGSL | 4.040 |
| 374 | LAVTSIPSV | 3.777 |
| 262 | VAITLLSLV | 3.777 |
| 299 | LQCRKQLGL | 3.682 |
| 335 | NMAYQQVHA | 3.588 |
| 291 | FPPWLETWL | 3.528 |
| 331 | YLFLNMAYQ | 3.209 |
| 148 | VVSAWALQL | 3.178 |
| 166 | YICSNNIQA | 3.142 |
| 353 | EVWRIEMYI | 3.125 |
| 221 | SLATFFFLY | 3.121 |
| 378 | SIPSVSNAL | 2.937 |
| 164 | QVYICSNNI | 2.921 |
| 268 | SLVYLAGLL | 2.777 |
| 396 | STLGYVALL | 2.525 |
| 434 | LALVLPSIV | 2.491 |
| 304 | QLGLLSFFF | 2.377 |
| 269 | LVYLAGLLA | 2.365 |
| 37 | GSGDFAKSL | 2.173 |

TABLE X-continued

V1-HLA-A0201-9mers-98P4B6
Each peptide is a portion of SEQ ID NO: 3;
each start position is specified, the
length of peptide is 9 amino acids, and
the end position for each peptide is the
start position plus eight.

| Start | Subsequence | Score |
|---|---|---|
| 366 | MSLGLLSLL | 2.017 |
| 267 | LSLVYLAGL | 2.017 |
| 242 | NQQSDFYKI | 2.010 |
| 177 | QVIELARQL | 1.533 |
| 224 | TFFFLYSFV | 1.474 |
| 349 | WNEEEVWRI | 1.418 |
| 128 | SNAEYLASL | 1.315 |
| 106 | HLLVGKILI | 1.312 |
| 257 | KTLPIVAIT | 1.264 |
| 303 | KQLGLLSFF | 1.238 |
| 428 | TPPNFVLAL | 1.219 |
| 34 | GVIGSGDFA | 1.172 |
| 216 | VVVAISLAT | 1.108 |
| 314 | MVHVAYSLC | 1.108 |
| 371 | LSLLAVTIS | 0.985 |
| 91 | VAIHREHYT | 0.968 |
| 85 | KTNIIFVAI | 0.964 |
| 133 | LASLFPDSL | 0.939 |
| 425 | RFYTPPNFV | 0.850 |
| 250 | IPIEIVNKT | 0.780 |
| 49 | LIRCGYHVV | 0.760 |
| 83 | LTKTNIIFV | 0.727 |
| 132 | YLASLFPDS | 0.651 |
| 427 | YTPPNFVLA | 0.603 |
| 171 | NIQARQQVI | 0.588 |
| 259 | LPIVAITLL | 0.545 |
| 438 | LPSIVILDL | 0.545 |
| 278 | AAYQLYYGT | 0.497 |
| 170 | NNIQARQQV | 0.454 |
| 385 | ALNWREFSF | 0.432 |

TABLE X

V2-HLA-A0201-9mers-98P4B6
Each peptide is a portion of SEQ ID NO: 5;
each start position is specified, the
length of peptide is 9 amino acids, and
the end position for each peptide is the
start position plus eight.

| Start | Subsequence | Score |
|---|---|---|
| 5 | GLQALSLSL | 21.362 |
| 10 | SLSLSSGFT | 5.328 |
| 17 | FTPFSCLSL | 1.365 |
| 15 | SGFTPFSCL | 0.980 |
| 1 | SGSPGLQAL | 0.321 |
| 14 | SSGFTPFSC | 0.188 |
| 8 | ALSLSLSSG | 0.171 |
| 12 | SLSSGFTPF | 0.142 |
| 3 | SPGLQALSL | 0.139 |
| 29 | WDYRCPPPC | 0.102 |
| 35 | PPCPADFFL | 0.098 |
| 22 | CLSLPSSWD | 0.082 |
| 37 | CPADFFLYF | 0.079 |
| 24 | SLPSSWDYR | 0.068 |
| 25 | LPSSWDYRC | 0.055 |
| 6 | LQALSLSLS | 0.030 |
| 23 | LSLPSSWDY | 0.023 |
| 13 | LSSGFTPFS | 0.017 |
| 20 | FSCLSLPSS | 0.005 |
| 7 | QALSLSLSS | 0.004 |
| 11 | LSLSSGFTP | 0.004 |
| 27 | SSWDYRCPP | 0.003 |
| 31 | YRCPPPCPA | 0.003 |
| 9 | LSLSLSSGF | 0.003 |
| 21 | SCLSLPSSW | 0.002 |
| 18 | TPFSCLSLP | 0.001 |
| 2 | GSPGLQALS | 0.000 |
| 33 | CPPPCPADF | 0.000 |
| 16 | GFTPFSCLS | 0.000 |
| 36 | PCPADFFLY | 0.000 |
| 32 | RCPPPCPAD | 0.000 |
| 4 | PGLQALSLS | 0.000 |
| 34 | PPPCPADFF | 0.000 |
| 19 | PFSCLSLPS | 0.000 |
| 28 | SWDYRCPPP | 0.000 |

TABLE X-continued

V2-HLA-A0201-9mers-98P4B6
Each peptide is a portion of SEQ ID NO: 5;
each start position is specified, the
length of peptide is 9 amino acids, and
the end position for each peptide is the
start position plus eight.

| Start | Subsequence | Score |
|---|---|---|
| 26 | PSSWDYRCP | 0.000 |
| 30 | DYRCPPPCP | 0.000 |

TABLE X

V5A-HLA-A0201-9mers-98P4B6
Each peptide is a portion of SEQ ID NO: 11;
each start position is specified, the
length of peptide is 9 amino acids, and
the end position for each peptide is the
start position plus eight.

| Start | Subsequence | Score |
|---|---|---|
| 7 | FTFWRGPVV | 6.741 |
| 1 | NLPLRLFTF | 0.994 |
| 8 | TFWRGPVVV | 0.164 |
| 5 | RLFTFWRGP | 0.071 |
| 2 | LPLRLFTFW | 0.032 |
| 6 | LFTFWRGPV | 0.011 |
| 3 | PLRLFTFWR | 0.003 |
| 4 | LRLFTFWRG | 0.001 |
| 9 | FWRGPVVVA | 0.000 |

TABLE X

V5B-HLA-A0201-9mers-98P4B6
Each peptide is a portion of SEQ ID NO: 11;
each start position is specified, the
length of peptide is 9 amino acids, and
the end position for each peptide is the
start position plus eight.

| Start | Subsequence | Score |
|---|---|---|
| 20 | LELEFVFLL | 543.025 |
| 6 | FIQIFCSFA | 65.673 |
| 24 | FVFLLTLLL | 31.814 |
| 22 | LEFVFLLTL | 22.835 |
| 8 | QIFCSFADT | 7.203 |
| 19 | ELELEFVFL | 1.072 |
| 17 | QTELELEFV | 0.383 |
| 10 | FCSFADTQT | 0.224 |
| 4 | FSFIQIFCS | 0.110 |
| 21 | ELEFVFLLT | 0.068 |
| 12 | SFADTQTEL | 0.061 |

TABLE X-continued

V5B-HLA-A0201-9mers-98P4B6
Each peptide is a portion of SEQ ID NO: 11;
each start position is specified, the
length of peptide is 9 amino acids, and
the end position for each peptide is the
start position plus eight.

| Start | Subsequence | Score |
|---|---|---|
| 18 | TELELEFVF | 0.052 |
| 16 | TQTELELEF | 0.031 |
| 14 | ADTQTELEL | 0.030 |
| 2 | REFSFIQIF | 0.019 |
| 7 | IQIFCSFAD | 0.015 |
| 23 | EFVFLLTLL | 0.003 |
| 3 | EFSFIQIFC | 0.001 |
| 1 | WREFSFIQI | 0.001 |
| 11 | CSFADTQTE | 0.000 |
| 13 | FADTQTELE | 0.000 |
| 5 | SFIQIFCSF | 0.000 |
| 9 | IFCSFADTQ | 0.000 |
| 15 | DTQTELELE | 0.000 |

TABLE X

V6-HLA-A0201-
9mers-98P4B6
Each peptide is a portion of
SEQ ID NO: 13; each start
position is specified, the
length of peptide is 9 amino
acids, and the end position
for each peptide is the start
position plus eight.

| Start | Subsequence | Score |
|---|---|---|
| 7 | ILGKIILFL | 459.398 |
| 27 | KGWEKSQFL | 91.350 |
| 10 | KIILFLPCI | 43.882 |
| 38 | GIGGTIPHV | 21.996 |
| 14 | FLPCISRKL | 19.653 |
| 17 | CISRKLKRI | 3.299 |
| 34 | FLEEGIGGT | 2.689 |
| 5 | IVILGKIIL | 1.303 |
| 4 | SIVILGKII | 0.588 |
| 43 | IPHVSPERV | 0.378 |
| 1 | VLPSIVILG | 0.291 |
| 46 | VSPERVTVM | 0.213 |
| 45 | HVSPERVTV | 0.207 |

TABLE X-continued

V6-HLA-A0201-9mers-98P4B6

Each peptide is a portion of SEQ ID NO: 13; each start position is specified, the length of peptide is 9 amino acids, and the end position for each peptide is the start position plus eight.

| Start | Subsequence | Score |
|---|---|---|
| 6 | VILGKIILF | 0.148 |
| 31 | KSQFLEEGI | 0.117 |
| 12 | ILFLPCISR | 0.094 |
| 11 | IILFLPCIS | 0.026 |
| 9 | GKIILFLPC | 0.013 |
| 21 | KLKRIKKGW | 0.009 |
| 35 | LEEGIGGTI | 0.003 |
| 42 | TIPHVSPER | 0.002 |
| 32 | SQFLEEGIG | 0.001 |
| 20 | RKLKRIKKG | 0.001 |
| 33 | QFLEEGIGG | 0.001 |
| 41 | GTIPHVSPE | 0.000 |
| 3 | PSIVILGKI | 0.000 |
| 2 | LPSIVILGK | 0.000 |
| 26 | KKGWEKSQF | 0.000 |
| 39 | IGGTIPHVS | 0.000 |
| 24 | RIKKGWEKS | 0.000 |
| 15 | LPCISRKLK | 0.000 |
| 13 | LFLPCISRK | 0.000 |
| 40 | GGTIPHVSP | 0.000 |
| 29 | WEKSQFLEE | 0.000 |
| 8 | LGKIILFLP | 0.000 |
| 23 | KRIKKGWEK | 0.000 |
| 37 | EGIGGTIPH | 0.000 |
| 30 | EKSQFLEEG | 0.000 |
| 44 | PHVSPERVT | 0.000 |
| 36 | EEGIGGTIP | 0.000 |
| 16 | PCISRKLKR | 0.000 |
| 22 | LKRIKKGWE | 0.000 |
| 25 | IKKGWEKSQ | 0.000 |
| 18 | ISRKLKRIK | 0.000 |
| 28 | GWEKSQFLE | 0.000 |
| 19 | SRKLKRIKK | 0.000 |

TABLE X

V7A-HLA-A0201-9mers-98P4B6

Each peptide is a portion of SEQ ID NO: 15; each start position is specified, the length of peptide is 9 amino acids, and the end position for each peptide is the start position plus eight.

| Start | Subsequence | Score |
|---|---|---|
| 9 | FLPNGINGI | 110.379 |
| 4 | SLSETFLPN | 0.581 |
| 6 | SETFLPNGI | 0.203 |
| 3 | KSLSETFLP | 0.007 |
| 2 | PKSLSETFL | 0.004 |
| 5 | LSETFLPNG | 0.000 |
| 8 | TFLPNGING | 0.000 |
| 7 | ETFLPNGIN | 0.000 |
| 1 | SPKSLSETF | 0.000 |

TABLE X

V7B-HLA-A0201-9mers-98P4B6

Each peptide is a portion of SEQ ID NO: 15; each start position is specified, the length of peptide is 9 amino acids, and the end position for each peptide is the start position plus eight.

| Start | Subsequence | Score |
|---|---|---|
| 6 | YQQSTLGYV | 53.345 |
| 3 | NMAYQQSTL | 15.428 |
| 9 | STLGYVALL | 2.525 |
| 1 | FLNMAYQQS | 0.514 |
| 2 | LNMAYQQST | 0.306 |
| 8 | QSTLGYVAL | 0.209 |
| 7 | QQSTLGYVA | 0.207 |
| 4 | MAYQQSTLG | 0.006 |
| 5 | AYQQSTLGY | 0.000 |

TABLE X

V7C-A0201-9mers-98P4B6

Each peptide is a portion of SEQ ID NO: 15; each start position is specified, the length of peptide is 9 amino acids, and the end position for each peptide is the start position plus eight.

| Start | Subsequence | Score |
|---|---|---|
| 4 | VILDLSVEV | 246.631 |
| 148 | SLAFTSWSL | 160.218 |
| 129 | PLWEFLLRL | 139.780 |
| 31 | GLSEIVLPI | 98.381 |
| 57 | AMWTEEAGA | 29.780 |
| 2 | SIVILDLSV | 9.563 |
| 126 | GVGPLWEFL | 8.564 |
| 5 | ILDLSVEVL | 6.712 |
| 152 | TSWSLGEFL | 3.119 |
| 27 | ILRGGLSEI | 3.100 |
| 42 | QQDRKIPPL | 1.993 |
| 168 | LETIILSKL | 1.624 |
| 127 | VGPLWEFLL | 0.375 |
| 163 | GTWMKLETI | 1.355 |
| 81 | SSQIPVVGV | 1.044 |
| 165 | WMKLETIIL | 1.018 |
| 112 | AANSWRNPV | 0.966 |
| 82 | SQIPVVGVV | 0.864 |
| 134 | LLRLLKSQA | 0.642 |
| 144 | SGTLSLAFT | 0.615 |
| 133 | FLLRLLKSQ | 0.583 |
| 39 | IEWQQDRKI | 0.572 |
| 159 | FLGSGTWMK | 0.514 |
| 119 | PVLPHTNGV | 0.495 |
| 185 | CMFSLISGS | 0.458 |
| 78 | SSSSSQIPV | 0.454 |
| 79 | SSSSQIPVV | 0.428 |
| 83 | QIPVVGVVT | 0.420 |
| 160 | LGSGTWMKL | 0.403 |
| 155 | SLGEFLGSG | 0.347 |
| 141 | QAASGTLSL | 0.297 |
| 136 | RLLKSQAAS | 0.276 |
| 52 | TPPPPAMWT | 0.268 |
| 14 | ASPAAAWKC | 0.243 |

TABLE X-continued

V7C-A0201-9mers-98P4B6

Each peptide is a portion of SEQ ID NO: 15; each start position is specified, the length of peptide is 9 amino acids, and the end position for each peptide is the start position plus eight.

| Start | Subsequence | Score |
|---|---|---|
| 15 | SPAAAWKCL | 0.237 |
| 181 | KSKHCMFSL | 0.228 |
| 88 | GVVTEDDEA | 0.213 |
| 22 | CLGANILRG | 0.171 |
| 10 | VEVLASPAA | 0.164 |
| 142 | AASGTLSLA | 0.159 |
| 146 | TLSLAFTSW | 0.142 |
| 12 | VLASPAAAW | 0.127 |
| 11 | EVLASPAAA | 0.121 |
| 49 | PLSTPPPPA | 0.109 |
| 178 | QEQKSKHCM | 0.097 |
| 59 | WTEEAGATA | 0.083 |
| 17 | AAAWKCLGA | 0.069 |
| 147 | LSLAFTSWS | 0.064 |
| 139 | KSQAASGTL | 0.063 |
| 35 | IVLPIEWQQ | 0.062 |
| 29 | RGGLSEIVL | 0.057 |
| 113 | ANSWRNPVL | 0.057 |
| 20 | WKCLGANIL | 0.056 |
| 50 | LSTPPPPAM | 0.055 |
| 175 | KLTQEQKSK | 0.052 |
| 162 | SGTWMKLET | 0.049 |
| 6 | LDLSVEVLA | 0.043 |
| 36 | VLPIEWQQD | 0.043 |
| 24 | GANILRGGL | 0.039 |
| 177 | TQEQKSKHC | 0.032 |
| 105 | SPDRALKAA | 0.030 |
| 171 | IILSKLTQE | 0.030 |
| 41 | WQQDRKIPP | 0.028 |
| 9 | SVEVLASPA | 0.028 |
| 182 | SKHCMFSLI | 0.028 |
| 172 | ILSKLTQEQ | 0.025 |
| 145 | GTLSLAFTS | 0.022 |

TABLE X-continued

V7C-A0201-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 138 | LKSQAASGT | 0.018 |
| 154 | WSLGEFLGS | 0.016 |
| 76 | NKSSSSSQI | 0.014 |
| 7 | DLSVEVLAS | 0.013 |
| 149 | LAFTSWSLG | 0.011 |
| 116 | WRNPVLPHT | 0.011 |
| 104 | ESPDRALKA | 0.010 |
| 66 | TAEAQESGI | 0.009 |
| 125 | NGVGPLWEF | 0.008 |
| 169 | ETIILSKLT | 0.008 |
| 167 | KLETIILSK | 0.008 |
| 26 | NILRGGLSE | 0.008 |
| 140 | SQAASGTLS | 0.008 |
| 61 | EEAGATAEA | 0.007 |
| 176 | LTQEQKSKH | 0.007 |
| 46 | KIPPLSTPP | 0.007 |
| 120 | VLPHTNGVG | 0.007 |
| 166 | MKLETIILS | 0.006 |
| 156 | LGEFLGSGT | 0.005 |
| 158 | EFLGSGTWM | 0.005 |
| 131 | WEFLLRLLK | 0.005 |
| 101 | DPPESPDRA | 0.005 |
| 89 | VVTEDDEAQ | 0.004 |
| 137 | LLKSQAASG | 0.004 |
| 135 | LRLLKSQAA | 0.004 |
| 108 | RALKAANSW | 0.004 |
| 28 | LRGGLSEIV | 0.003 |
| 109 | ALKAANSWR | 0.003 |
| 18 | AAWKCLGAN | 0.003 |
| 91 | TEDDEAQDS | 0.002 |
| 164 | TWMKLETII | 0.002 |
| 3 | IVILDLSVE | 0.002 |
| 65 | ATAEAQESG | 0.002 |

TABLE XI

V1-HLA-A0201-10mers-98P4B6
Each peptide is a portion of SEQ ID NO: 3; each start position is specified, the length of peptide is 10 amino acids, and the end position for each peptide is the start position plus nine.

| Start | Subsequence | Score |
|---|---|---|
| 100 | SLWDLRHLLV | 2366.855 |
| 306 | GLLSFFFAMV | 1858.012 |
| 82 | ALTKTNIIFV | 879.833 |
| 304 | QLGLLSFFFA | 301.110 |
| 373 | LLAVTSIPSV | 271.948 |
| 107 | LLVGKILIDV | 271.948 |
| 132 | YLASLFPDSL | 182.973 |
| 219 | AISLATFFFL | 178.032 |
| 367 | SLGLLSLLAV | 159.970 |
| 385 | ALNWREFSFI | 109.023 |
| 298 | WLQCRKQLGL | 98.267 |
| 437 | VLPSIVILDL | 83.527 |
| 266 | LLSLVYLAGL | 83.527 |
| 403 | LLISTFHVLI | 67.396 |
| 402 | ALLISTFHVL | 61.573 |
| 365 | IMSLGLLSLL | 60.325 |
| 140 | SLIVKGFNVV | 54.181 |
| 258 | TLPIVAITLL | 49.134 |
| 433 | VLALVLPSIV | 48.478 |
| 48 | RLIRCGYHVV | 42.774 |
| 370 | LLSLLAVTSI | 40.792 |
| 210 | TLWRGPVVA | 38.884 |
| 263 | AITLLSLVYL | 37.157 |
| 432 | FVLALVLPSI | 35.735 |
| 401 | VALLISTFHV | 35.242 |
| 207 | RLFTLWRGPV | 33.455 |
| 227 | FLYSFVRDVI | 30.852 |
| 223 | ATFFFLYSFV | 29.487 |
| 65 | FASEFFPHVV | 28.385 |
| 364 | GIMSLGLLSL | 24.997 |
| 261 | IVAITLLSLV | 23.795 |
| 435 | ALVLPSIVIL | 20.145 |
| 90 | FVAIHREHYT | 16.497 |
| 179 | IELARQLNFI | 16.141 |

TABLE XI-continued

V1-HLA-A0201-
10mers-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 427 | YTPPNFVLAL | 11.929 |
| 67 | SEFFPHVVDV | 11.509 |
| 111 | KILIDVSNNM | 8.846 |
| 305 | LGLLSFFFAM | 8.542 |
| 172 | IQARQQVIEL | 8.469 |
| 249 | KIPIEIVNKT | 8.248 |
| 183 | RQLNFIPIDL | 8.014 |
| 95 | REHYTSLWDL | 7.165 |
| 440 | SIVILDLLQL | 6.756 |
| 209 | FTLWRGPVVV | 6.741 |
| 308 | LSFFFAMVHV | 6.568 |
| 57 | VIGSRNPKFA | 6.387 |
| 419 | FEEEYYRFYT | 5.579 |
| 394 | IQSTLGYVAL | 5.523 |
| 269 | LVYLAGLLAA | 5.439 |
| 313 | AMVHVAYSLC | 5.382 |
| 312 | FAMVHVAYSL | 5.050 |
| 268 | SLVYLAGLLA | 4.968 |
| 92 | AIHREHYTSL | 4.406 |
| 243 | QQSDFYKIPI | 4.337 |
| 257 | KTLPIVAITL | 3.842 |
| 231 | FVRDVIHPYA | 3.427 |
| 314 | MVHVAYSLCL | 3.178 |
| 303 | KQLGLLSFFF | 3.121 |
| 221 | SLATFFFLYS | 2.959 |
| 144 | KGFNVVSAWA | 2.310 |
| 286 | TKYRRFPPWL | 1.984 |
| 147 | NVVSAWALQL | 1.869 |
| 199 | REIENLPLRL | 1.703 |
| 441 | IVILDLLQLC | 1.700 |
| 389 | REFSFIQSTL | 1.537 |
| 226 | FFLYSFVRDV | 1.437 |
| 24 | GIKDARKVTV | 1.372 |

TABLE XI-continued

V1-HLA-A0201-
10mers-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 201 | IENLPLRLFT | 1.355 |
| 393 | FIQSTLGYVA | 1.288 |
| 64 | KFASEFFPHV | 1.221 |
| 152 | WALQLGPKDA | 1.174 |
| 345 | IENSWNEEEV | 1.127 |
| 299 | LQCRKQLGLL | 1.101 |
| 163 | RQVYICSNNI | 1.058 |
| 428 | TPPNFVLALV | 1.044 |
| 264 | ITLLSLVYLA | 0.998 |
| 113 | LIDVSNNMRI | 0.975 |
| 250 | IPIEIVNKTL | 0.972 |
| 43 | KSLTIRLIRC | 0.966 |
| 323 | LPMRRSERYL | 0.965 |
| 424 | YRFYTPPNFV | 0.904 |
| 36 | IGSGDFAKSL | 0.901 |
| 361 | ISFGIMSLGL | 0.877 |
| 4 | ISMMGSPKSL | 0.877 |
| 336 | MAYQQVHANI | 0.788 |
| 139 | DSLIVKGFNV | 0.731 |
| 12 | SLSETCLPNG | 0.703 |
| 275 | LLAAAYQLYY | 0.697 |
| 134 | ASLFPDSLIV | 0.689 |
| 121 | RINQYPESNA | 0.683 |
| 253 | EIVNKTLPIV | 0.676 |
| 98 | YTSLWDLRHL | 0.628 |
| 398 | LGYVALLIST | 0.609 |
| 16 | TCLPNGINGI | 0.580 |
| 396 | STLGYVALLI | 0.536 |
| 356 | RIEMYISFGI | 0.532 |
| 202 | ENLPLRLFTL | 0.516 |
| 99 | TSLWDLRHLL | 0.516 |
| 273 | AGLLAAAYQL | 0.516 |
| 332 | LFLNMAYQQV | 0.456 |

TABLE XI

V2-HLA-A0201-
10mers-98P4B6
Each peptide is a portion of
SEQ ID NO: 5; each start
position is specified, the
length of peptide is 10 amino
acids, and the end position
for each peptide is the start
position plus nine.

| Start | Subsequence | Score |
|---|---|---|
| 24 | SLPSSWDYRC | 4.968 |
| 12 | SLSSGFTPFS | 1.557 |
| 22 | CLSLPSSWDY | 0.559 |
| 13 | LSSGFTPFSC | 0.320 |
| 14 | SSGFTPFSCL | 0.265 |
| 9 | LSLSLSSGFT | 0.219 |
| 5 | GLQALSLSLS | 0.171 |
| 2 | GSPGLQALSL | 0.139 |
| 34 | PPPCPADFFL | 0.098 |
| 10 | SLSLSSGFTP | 0.086 |
| 8 | ALSLSLSSGF | 0.075 |
| 16 | GFTPFSCLSL | 0.015 |
| 6 | LQALSLSLSS | 0.013 |
| 4 | PGLQALSLSL | 0.011 |
| 7 | QALSLSLSSG | 0.009 |
| 15 | SGFTPFSCLS | 0.007 |
| 11 | LSLSSGFTPF | 0.006 |
| 27 | SSWDYRCPPP | 0.003 |
| 23 | LSLPSSWDYR | 0.003 |
| 20 | FSCLSLPSSW | 0.002 |
| 17 | FTPFSCLSLP | 0.002 |
| 21 | SCLSLPSSWD | 0.002 |
| 18 | TPFSCLSLPS | 0.002 |
| 33 | CPPPCPADFF | 0.001 |
| 3 | SPGLQALSLS | 0.001 |
| 32 | RCPPPCPADF | 0.000 |
| 1 | SGSPGLQALS | 0.000 |
| 36 | PCPADFFLYF | 0.000 |
| 29 | WDYRCPPPCP | 0.000 |
| 28 | SWDYRCPPPC | 0.000 |
| 35 | PPCPADFFLY | 0.000 |
| 25 | LPSSWDYRCP | 0.000 |
| 31 | YRCPPPCPAD | 0.000 |
| 30 | DYRCPPPCPA | 0.000 |

TABLE XI-continued

V2-HLA-A0201-
10mers-98P4B6
Each peptide is a portion of
SEQ ID NO: 5; each start
position is specified, the
length of peptide is 10 amino
acids, and the end position
for each peptide is the start
position plus nine.

| Start | Subsequence | Score |
|---|---|---|
| 19 | PFSCLSLPSS | 0.000 |
| 26 | PSSWDYRCPP | 0.000 |

TABLE XI

V5A-HLA-A0201-
10mers-98P4B6
Each peptide is a portion of
SEQ ID NO: 11; each start
position is specified, the
length of peptide is 10 amino
acids, and the end position
for each peptide is the start
position plus nine.

| Start | Subsequence | Score |
|---|---|---|
| 6 | RLFTFWRGPV | 33.455 |
| 8 | FTFWRGPVVV | 6.741 |
| 2 | NLPLRLFTFW | 0.779 |
| 3 | LPLRLFTFWR | 0.074 |
| 7 | LFTFWRGPVV | 0.034 |
| 9 | TFWRGPVVVA | 0.027 |
| 1 | ENLPLRLFTF | 0.002 |
| 4 | PLRLFTFWRG | 0.002 |
| 10 | FWRGPVVVAI | 0.001 |
| 5 | LRLFTFWRGP | 0.000 |

TABLE XI

V5B-HLA-A0201-
10mers-98P4B6
Each peptide is a portion of
SEQ ID NO: 11; each start
position is specified, the
length of peptide is 10 amino
acids, and the end position
for each peptide is the start
position plus nine.

| Start | Subsequence | Score |
|---|---|---|
| 17 | TQTELELEFV | 179.213 |
| 19 | TELELEFVFL | 65.849 |
| 21 | LELEFVFLLT | 7.100 |
| 23 | LEFVFLLTLL | 6.009 |
| 20 | ELELEFVFLL | 5.198 |

TABLE XI-continued

V5B-HLA-A0201-
10mers-98P4B6
Each peptide is a portion of
SEQ ID NO: 11; each start
position is specified, the
length of peptide is 10 amino
acids, and the end position
for each peptide is the start
position plus nine.

| Start | Subsequence | Score |
|---|---|---|
| 8 | IQIFCSFADT | 2.440 |
| 3 | REFSFIQIFC | 1.966 |
| 22 | ELEFVFLLTL | 0.896 |
| 14 | FADTQTELEL | 0.546 |
| 12 | CSFADTQTEL | 0.516 |
| 6 | SFIQIFCSFA | 0.072 |
| 7 | FIQIFCSFAD | 0.055 |
| 5 | FSFIQIFCSF | 0.016 |
| 9 | QIFCSFADTQ | 0.014 |
| 10 | IFCSFADTQT | 0.009 |
| 24 | EFVFLLTLLL | 0.001 |
| 1 | NWREFSFIQI | 0.001 |
| 11 | FCSFADTQTE | 0.000 |
| 18 | QTELELEFVF | 0.000 |
| 16 | DTQTELELEF | 0.000 |
| 4 | EFSFIQIFCS | 0.000 |
| 15 | ADTQTELELE | 0.000 |
| 13 | SFADTQTELE | 0.000 |
| 2 | WREFSFIQIF | 0.000 |

TABLE XI

V6-HLA-A0201-
10mers-98P4B6
Each peptide is a portion of
SEQ ID NO: 13; each start
position is specified, the
length of peptide is 10 amino
acids, and the end position
for each peptide is the start
position plus nine.

| Start | Subsequence | Score |
|---|---|---|
| 7 | VILGKIILFL | 233.719 |
| 43 | TIPHVSPERV | 4.686 |
| 35 | FLEEGIGGTI | 1.637 |
| 5 | SIVILGKIIL | 1.204 |
| 27 | KKGWEKSQFL | 0.571 |
| 8 | ILGKIILFLP | 0.338 |

TABLE XI-continued

V6-HLA-A0201-
10mers-98P4B6
Each peptide is a portion of
SEQ ID NO: 13; each start
position is specified, the
length of peptide is 10 amino
acids, and the end position
for each peptide is the start
position plus nine.

| Start | Subsequence | Score |
|---|---|---|
| 13 | ILFLPCISRK | 0.216 |
| 10 | GKIILFLPCI | 0.127 |
| 1 | LVLPSIVILG | 0.094 |
| 38 | EGIGGTIPHV | 0.078 |
| 15 | FLPCISRKLK | 0.069 |
| 28 | KGWEKSQFLE | 0.067 |
| 2 | VLPSIVILGK | 0.058 |
| 3 | LPSIVILGKI | 0.035 |
| 33 | SQFLEEGIGG | 0.028 |
| 6 | IVILGKIILF | 0.025 |
| 34 | QFLEEGIGGT | 0.023 |
| 14 | LFLPCISRKL | 0.019 |
| 11 | KIILFLPCIS | 0.015 |
| 46 | HVSPERVTVM | 0.014 |
| 12 | IILFLPCISR | 0.013 |
| 44 | IPHVSPERVT | 0.007 |
| 39 | GIGGTIPHVS | 0.004 |
| 9 | LGKIILFLPC | 0.004 |
| 17 | PCISRKLKRI | 0.003 |
| 22 | KLKRIKKGWE | 0.001 |
| 45 | PHVSPERVTV | 0.001 |
| 30 | WEKSQFLEEG | 0.001 |
| 4 | PSIVILGKII | 0.001 |
| 31 | EKSQFLEEGI | 0.001 |
| 21 | RKLKRIKKGW | 0.000 |
| 41 | GGTIPHVSPE | 0.000 |
| 42 | GTIPHVSPER | 0.000 |
| 18 | CISRKLKRIK | 0.000 |
| 40 | IGGTIPHVSP | 0.000 |
| 16 | LPCISRKLKR | 0.000 |
| 37 | EEGIGGTIPH | 0.000 |
| 32 | KSQFLEEGIG | 0.000 |
| 25 | RIKKGWEKSQ | 0.000 |

TABLE XI-continued

V6-HLA-A0201-10mers-98P4B6

Each peptide is a portion of SEQ ID NO: 13; each start position is specified, the length of peptide is 10 amino acids, and the end position for each peptide is the start position plus nine.

| Start | Subsequence | Score |
|---|---|---|
| 24 | KRIKKGWEKS | 0.000 |
| 23 | LKRIKKGWEK | 0.000 |
| 36 | LEEGIGGTIP | 0.000 |
| 19 | ISRKLKRIKK | 0.000 |
| 26 | IKKGWEKSQF | 0.000 |
| 20 | SRKLKRIKKG | 0.000 |
| 29 | GWEKSQFLEE | 0.000 |

TABLE XI

V7A-HLA-A0201-10mers-98P4B6

Each peptide is a portion of SEQ ID NO: 15; each start position is specified, the length of peptide is 10 amino acids, and the end position for each peptide is the start position plus nine.

| Start | Subsequence | Score |
|---|---|---|
| 5 | SLSETFLPNG | 2.670 |
| 9 | TFLPNGINGI | 0.062 |
| 2 | SPKSLSETFL | 0.027 |
| 4 | KSLSETFLPN | 0.012 |
| 6 | LSETFLPNGI | 0.007 |
| 10 | FLPNGINGIK | 0.004 |
| 8 | ETFLPNGING | 0.000 |
| 1 | GSPKSLSETF | 0.000 |
| 7 | SETFLPNGIN | 0.000 |
| 3 | PKSLSETFLP | 0.000 |

TABLE XI

V7B-HLA-A0201-10mers-98P4B6

Each peptide is a portion of SEQ ID NO: 15; each start position is specified, the length of peptide is 10 amino acids, and the end position for each peptide is the start position plus nine.

| Start | Subsequence | Score |
|---|---|---|
| 2 | FLNMAYQQST | 34.279 |
| 8 | QQSTLGYVAL | 3.249 |
| 7 | YQQSTLGYVA | 0.950 |
| 3 | LNMAYQQSTL | 0.877 |
| 10 | STLGYVALLI | 0.536 |
| 9 | QSTLGYVALL | 0.321 |
| 4 | NMAYQQSTLG | 0.054 |
| 6 | AYQQSTLGYV | 0.016 |
| 5 | MAYQQSTLGY | 0.006 |
| 1 | LFLNMAYQQS | 0.000 |

TABLE XI

V7C-HLA-A0201-10mers-98P4B6

Each peptide is a portion of SEQ ID NO: 15; each start position is specified, the length of peptide is 10 amino acids, and the end position for each peptide is the start position plus nine.

| Start | Subsequence | Score |
|---|---|---|
| 160 | FLGSGTWMKL | 167.054 |
| 42 | WQQDRKIPPL | 93.953 |
| 134 | FLLRLLKSQA | 84.555 |
| 5 | VILDLSVEVL | 35.002 |
| 156 | SLGEFLGSGT | 30.553 |
| 27 | NILRGGLSEI | 12.208 |
| 168 | KLETIILSKL | 11.006 |
| 127 | GVGPLWEFLL | 10.841 |
| 4 | IVILDLSVEV | 10.346 |
| 130 | PLWEFLLRLL | 7.357 |
| 148 | LSLAFTSWSL | 6.579 |
| 58 | AMWTEEAGAT | 5.807 |
| 129 | GPLWEFLLRL | 4.510 |
| 152 | FTSWSLGEFL | 3.678 |
| 112 | KAANSWRNPV | 3.381 |

TABLE XI-continued

V7C-HLA-A0201-10mers-98P4B6
Each peptide is a portion of SEQ ID NO: 15; each start position is specified, the length of peptide is 10 amino acids, and the end position for each peptide is the start position plus nine.

| Start | Subsequence | Score |
|---|---|---|
| 6 | ILDLSVEVLA | 3.378 |
| 141 | SQAASGTLSL | 2.166 |
| 158 | GEFLGSGTWM | 1.966 |
| 28 | ILRGGLSEIV | 1.805 |
| 78 | KSSSSSQIPV | 1.589 |
| 147 | TLSLAFTSWS | 1.557 |
| 19 | AAWKCLGANI | 1.203 |
| 81 | SSSQIPVVGV | 1.044 |
| 14 | LASPAAAWKC | 0.880 |
| 135 | LLRLLKSQAA | 0.642 |
| 126 | NGVGPLWEFL | 0.639 |
| 144 | ASGTLSLAFT | 0.615 |
| 66 | ATAEAQESGI | 0.594 |
| 31 | GGLSEIVLPI | 0.580 |
| 52 | STPPPPAMWT | 0.569 |
| 164 | GTWMKLETII | 0.493 |
| 177 | LTQEQKSKHC | 0.481 |
| 119 | NPVLPHTNGV | 0.454 |
| 138 | LLKSQAASGT | 0.443 |
| 79 | SSSSSQIPVV | 0.428 |
| 181 | QKSKHCMFSL | 0.396 |
| 83 | SQIPVVGVVT | 0.310 |
| 137 | RLLKSQAASG | 0.276 |
| 176 | KLTQEQKSKH | 0.261 |
| 169 | LETIILSKLT | 0.246 |
| 15 | ASPAAAWKCL | 0.237 |
| 9 | LSVEVLASPA | 0.226 |
| 11 | VEVLASPAAA | 0.164 |
| 92 | TEDDEAQDSI | 0.163 |
| 142 | QAASGTLSLA | 0.159 |
| 13 | VLASPAAAWK | 0.139 |
| 149 | SLAFTSWSLG | 0.127 |
| 113 | AANSWRNPVL | 0.122 |
| 50 | PLSTPPPPAM | 0.109 |

TABLE XI-continued

V7C-HLA-A0201-10mers-98P4B6
Each peptide is a portion of SEQ ID NO: 15; each start position is specified, the length of peptide is 10 amino acids, and the end position for each peptide is the start position plus nine.

| Start | Subsequence | Score |
|---|---|---|
| 163 | SGTWMKLETI | 0.077 |
| 122 | LPHTNGVGPL | 0.071 |
| 32 | GLSEIVLPIE | 0.058 |
| 132 | WEFLLRLLKS | 0.057 |
| 82 | SSQIPVVGVV | 0.056 |
| 162 | GSGTWMKLET | 0.049 |
| 23 | CLGANILRGG | 0.034 |
| 178 | TQEQKSKHCM | 0.032 |
| 24 | LGANILRGGL | 0.031 |
| 10 | SVEVLASPAA | 0.028 |
| 88 | VGVVTEDDEA | 0.027 |
| 37 | VLPIEWQQDR | 0.025 |
| 121 | VLPHTNGVGP | 0.025 |
| 153 | TSWSLGEFLG | 0.023 |
| 105 | ESPDRALKAA | 0.023 |
| 166 | WMKLETIILS | 0.020 |
| 110 | ALKAANSWRN | 0.020 |
| 182 | KSKHCMFSLI | 0.016 |
| 22 | KCLGANILRG | 0.014 |
| 36 | IVLPIEWQQD | 0.014 |
| 172 | IILSKLTQEQ | 0.013 |
| 173 | ILSKLTQEQK | 0.012 |
| 2 | PSIVILDLSV | 0.010 |
| 155 | WSLGEFLGSG | 0.009 |
| 115 | NSWRNPVLPH | 0.009 |
| 90 | VVTEDDEAQD | 0.009 |
| 102 | DPPESPDRAL | 0.009 |
| 125 | TNGVGPLWEF | 0.008 |
| 146 | GTLSLAFTSW | 0.007 |
| 47 | KIPPLSTPPP | 0.007 |
| 139 | LKSQAASGTL | 0.007 |
| 61 | TEEAGATAEA | 0.006 |
| 101 | IDPPESPDRA | 0.006 |

TABLE XI-continued

V7C-HLA-A0201-10mers-98P4B6

Each peptide is a portion of SEQ ID NO: 15; each start position is specified, the length of peptide is 10 amino acids, and the end position for each peptide is the start position plus nine.

| Start | Subsequence | Score |
|---|---|---|
| 57 | PAMWTEEAGA | 0.006 |
| 59 | MWTEEAGATA | 0.005 |
| 171 | TIILSKLTQE | 0.005 |
| 84 | QIPVVGVVTE | 0.005 |
| 165 | TWMKLETIIL | 0.005 |
| 109 | RALKAANSWR | 0.004 |
| 97 | AQDSIDPPES | 0.003 |
| 43 | QQDRKIPPLS | 0.003 |
| 145 | SGTLSLAFTS | 0.003 |
| 49 | PPLSTPPPPA | 0.003 |
| 8 | DLSVEVLASP | 0.003 |
| 76 | RNKSSSSSQI | 0.002 |
| 104 | PESPDRALKA | 0.002 |
| 29 | LRGGLSEIVL | 0.002 |
| 3 | SIVILDLSVE | 0.002 |
| 12 | EVLASPAAAW | 0.002 |
| 34 | SEIVLPIEWQ | 0.002 |
| 140 | KSQAASGTLS | 0.002 |

TABLE XII

V1-HLA-A3-9mers-98P4B6

Each peptide is a portion of SEQ ID NO: 3; each start position is specified, the length of peptide is 9 amino acids, and the end position for each peptide is the start position plus eight.

| Start | Subsequence | Score |
|---|---|---|
| 221 | SLATFFFLY | 108.000 |
| 306 | GLLSFFFAM | 24.300 |
| 294 | WLETWLQCR | 18.000 |
| 281 | QLYYGTKYR | 10.000 |
| 249 | KIPIEIVNK | 9.000 |
| 103 | DLRHLLVGK | 9.000 |
| 274 | GLLAAAYQL | 8.100 |

TABLE XII-continued

V1-HLA-A3-9mers-98P4B6

Each peptide is a portion of SEQ ID NO: 3; each start position is specified, the length of peptide is 9 amino acids, and the end position for each peptide is the start position plus eight.

| Start | Subsequence | Score |
|---|---|---|
| 443 | ILDLLQLCR | 8.000 |
| 223 | ATFFFLYSF | 6.750 |
| 304 | QLGLLSFFF | 6.000 |
| 155 | QLGPKDASR | 6.000 |
| 385 | ALNWREFSF | 6.000 |
| 35 | VIGSGDFAK | 6.000 |
| 409 | HVLIYGWKR | 5.400 |
| 56 | VVIGSRNPK | 4.500 |
| 313 | AMVHVAYSL | 4.050 |
| 82 | ALTKTNIIF | 4.000 |
| 322 | CLPMRRSER | 4.000 |
| 275 | LLAAAYQLY | 4.000 |
| 135 | SLFPDSLIV | 3.000 |
| 100 | SLWDLRHLL | 3.000 |
| 21 | GINGIKDAR | 2.700 |
| 403 | LLISTFHVL | 2.700 |
| 265 | TLLSLVYLA | 2.700 |
| 435 | ALVLPSIVI | 2.700 |
| 203 | NLPLRLFTL | 2.700 |
| 205 | PLRLFTLWR | 2.400 |
| 3 | SISMMGSPK | 2.000 |
| 258 | TLPIVAITL | 1.800 |
| 184 | QLNFIPIDL | 1.800 |
| 397 | TLGYVALLI | 1.800 |
| 365 | IMSLGLLSL | 1.800 |
| 307 | LLSFFFAMV | 1.800 |
| 87 | NIIFVAIHR | 1.800 |
| 106 | HLLVGKILI | 1.800 |
| 433 | VLALVLPSI | 1.350 |
| 191 | DLGSLSSAR | 1.200 |
| 210 | TLWRGPVVV | 1.000 |
| 140 | SLIVKGFNV | 0.900 |
| 17 | CLPNGINGI | 0.900 |
| 231 | FVRDVIHPY | 0.900 |

TABLE XII-continued

V1-HLA-A3-
9mers-98P4B6
Each peptide is a portion of
SEQ ID NO: 3; each start
position is specified, the
length of peptide is 9 amino
acids, and the end position
for each peptide is the start
position plus eight.

| Start | Subsequence | Score |
|---|---|---|
| 48 | RLIRCGYHV | 0.900 |
| 402 | ALLISTFHV | 0.900 |
| 227 | FLYSFVRDV | 0.900 |
| 417 | RAFEEEYYR | 0.900 |
| 263 | AITLLSLVY | 0.800 |
| 5 | SMMGSPKSL | 0.675 |
| 369 | GLLSLLAVT | 0.675 |
| 396 | STLGYVALL | 0.608 |
| 303 | KQLGLLSFF | 0.608 |
| 44 | SLTIRLIRC | 0.600 |
| 381 | SVSNALNWR | 0.600 |
| 46 | TIRLIRCGY | 0.600 |
| 219 | AISLATFFF | 0.600 |
| 280 | YQLYYGTKY | 0.540 |
| 411 | LIYGWKRAF | 0.450 |
| 271 | YLAGLLAAA | 0.450 |
| 112 | ILIDVSNNM | 0.450 |
| 85 | KTNIIFVAI | 0.405 |
| 90 | FVAIHREHY | 0.400 |
| 367 | SLGLLSLLA | 0.400 |
| 113 | LIDVSNNMR | 0.400 |
| 148 | VVSAWALQL | 0.360 |
| 175 | RQQVIELAR | 0.360 |
| 217 | VVAISLATF | 0.300 |
| 164 | QVYICSNNI | 0.300 |
| 400 | YVALLISTF | 0.300 |
| 43 | KSLTIRLIR | 0.270 |
| 441 | IVILDLLQL | 0.270 |
| 268 | SLVYLAGLL | 0.270 |
| 180 | ELARQLNFI | 0.270 |
| 353 | EVWRIEMYI | 0.270 |
| 358 | EMYISFGIM | 0.270 |
| 276 | LAAAYQLYY | 0.240 |

TABLE XII-continued

V1-HLA-A3-
9mers-98P4B6
Each peptide is a portion of
SEQ ID NO: 3; each start
position is specified, the
length of peptide is 9 amino
acids, and the end position
for each peptide is the start
position plus eight.

| Start | Subsequence | Score |
|---|---|---|
| 436 | LVLPSIVIL | 0.203 |
| 335 | NMAYQQVHA | 0.200 |
| 57 | VIGSRNPKF | 0.200 |
| 269 | LVYLAGLLA | 0.200 |
| 333 | FLNMAYQQV | 0.200 |
| 261 | IVAITLLSL | 0.180 |
| 225 | FFFLYSFVR | 0.180 |
| 360 | YISFGIMSL | 0.180 |
| 437 | VLPSIVILD | 0.180 |
| 404 | LISTFHVLI | 0.180 |
| 242 | NQQSDFYKI | 0.162 |
| 257 | KTLPIVAIT | 0.152 |
| 331 | YLFLNMAYQ | 0.150 |
| 410 | VLIYGWKRA | 0.150 |
| 34 | GVIGSGDFA | 0.135 |
| 18 | LPNGINGIK | 0.135 |
| 107 | LLVGKILID | 0.135 |
| 241 | RNQQSDFYK | 0.120 |
| 405 | ISTFHVLIY | 0.120 |
| 132 | YLASLFPDS | 0.120 |
| 428 | TPPNFVLAL | 0.108 |
| 153 | ALQLGPKDA | 0.100 |
| 108 | LVGKILIDV | 0.090 |
| 378 | SIPSVSNAL | 0.090 |
| 141 | LIVKGFNVV | 0.090 |
| 282 | LYYGTKYRR | 0.090 |

TABLE XII

V2-HLA-A3-9mers-98P4B6

Each peptide is a portion of SEQ ID NO: 5; each start position is specified, the length of peptide is 9 amino acids, and the end position for each peptide is the start position plus eight.

| Start | Subsequence | Score |
|---|---|---|
| 12 | SLSSGFTPF | 6.000 |
| 24 | SLPSSWDYR | 4.000 |
| 5 | GLQALSLSL | 3.600 |
| 37 | CPADFFLYF | 0.360 |
| 23 | LSLPSSWDY | 0.135 |
| 17 | FTPFSCLSL | 0.060 |
| 36 | PCPADFFLY | 0.036 |
| 8 | ALSLSLSSG | 0.030 |
| 22 | CLSLPSSWD | 0.030 |
| 10 | SLSLSSGFT | 0.030 |
| 33 | CPPPCPADF | 0.030 |
| 25 | LPSSWDYRC | 0.018 |
| 9 | LSLSLSSGF | 0.015 |
| 15 | SGFTPFSCL | 0.013 |
| 3 | SPGLQALSL | 0.012 |
| 34 | PPPCPADFF | 0.003 |
| 14 | SSGFTPFSC | 0.003 |
| 21 | SCLSLPSSW | 0.003 |
| 35 | PPCPADFFL | 0.003 |
| 6 | LQALSLSLS | 0.002 |
| 18 | TPFSCLSLP | 0.002 |
| 27 | SSWDYRCPP | 0.002 |
| 1 | SGSPGLQAL | 0.001 |
| 7 | QALSLSLSS | 0.001 |
| 29 | WDYRCPPPC | 0.001 |
| 13 | LSSGFTPFS | 0.001 |
| 2 | GSPGLQALS | 0.001 |
| 16 | GFTPFSCLS | 0.001 |
| 31 | YRCPPPCPA | 0.000 |
| 11 | LSLSSGFTP | 0.000 |
| 32 | RCPPPCPAD | 0.000 |
| 20 | FSCLSLPSS | 0.000 |
| 28 | SWDYRCPPP | 0.000 |
| 4 | PGLQALSLS | 0.000 |
| 30 | DYRCPPPCP | 0.000 |
| 19 | PFSCLSLPS | 0.000 |
| 26 | PSSWDYRCP | 0.000 |

TABLE XII

V5A-HLA-A3-9mers-98P4B6

Each peptide is a portion of SEQ ID NO: 11; each start position is specified, the length of peptide is 9 amino acids, and the end position for each peptide is the start position plus eight.

| Start | Subsequence | Score |
|---|---|---|
| 1 | NLPLRLFTF | 9.000 |
| 3 | PLRLFTFWR | 3.600 |
| 7 | FTFWRGPVV | 0.050 |
| 5 | RLFTFWRGP | 0.030 |
| 2 | LPLRLFTFW | 0.009 |
| 9 | FWRGPVVVA | 0.001 |
| 8 | TFWRGPVVV | 0.001 |
| 4 | LRLFTFWRG | 0.000 |
| 6 | LFTFWRGPV | 0.000 |

TABLE XII

V5B-HLA-A3-9mers-98P4B6

Each peptide is a portion of SEQ ID NO: 11; each start position is specified, the length of peptide is 9 amino acids, and the end position for each peptide is the start position plus eight.

| Start | Subsequence | Score |
|---|---|---|
| 24 | FVFLLTLLL | 0.600 |
| 19 | ELELEFVFL | 0.540 |
| 21 | ELEFVFLLT | 0.270 |
| 16 | TQTELELEF | 0.180 |
| 8 | QIFCSFADT | 0.150 |

TABLE XII-continued

V5B-HLA-A3-
9mers-98P4B6
Each peptide is a portion of
SEQ ID NO: 11; each start
position is specified, the
length of peptide is 9 amino
acids, and the end position
for each peptide is the start
position plus eight.

| Start | Subsequence | Score |
|---|---|---|
| 2 | REFSFIQIF | 0.135 |
| 20 | LELEFVFLL | 0.109 |
| 22 | LEFVFLLTL | 0.081 |
| 6 | FIQIFCSFA | 0.060 |
| 18 | TELELEFVF | 0.041 |
| 17 | QTELELEFV | 0.015 |
| 5 | SFIQIFCSF | 0.013 |
| 4 | FSFIQIFCS | 0.005 |
| 1 | WREFSFIQI | 0.004 |
| 7 | IQIFCSFAD | 0.003 |
| 14 | ADTQTELEL | 0.001 |
| 10 | FCSFADTQT | 0.001 |
| 12 | SFADTQTEL | 0.001 |
| 11 | CSFADTQTE | 0.001 |
| 15 | DTQTELELE | 0.000 |
| 23 | EFVFLLTLL | 0.000 |
| 13 | FADTQTELE | 0.000 |
| 3 | EFSFIQIFC | 0.000 |
| 9 | IFCSFADTQ | 0.000 |

TABLE XII

V6-HLA-A3-
9mers-98P4B6
Each peptide is a portion of
SEQ ID NO: 13; each start
position is specified, the
length of peptide is 9 amino
acids, and the end position
for each peptide is the start
position plus eight.

| Start | Subsequence | Score |
|---|---|---|
| 12 | ILFLPCISR | 60.000 |
| 7 | ILGKIILFL | 2.700 |
| 6 | VILGKIILF | 1.350 |
| 10 | KIILFLPCI | 1.215 |
| 2 | LPSIVILGK | 0.900 |
| 42 | TIPHVSPER | 0.600 |

TABLE XII-continued

V6-HLA-A3-
9mers-98P4B6
Each peptide is a portion of
SEQ ID NO: 13; each start
position is specified, the
length of peptide is 9 amino
acids, and the end position
for each peptide is the start
position plus eight.

| Start | Subsequence | Score |
|---|---|---|
| 21 | KLKRIKKGW | 0.450 |
| 23 | KRIKKGWEK | 0.270 |
| 5 | IVILGKIIL | 0.180 |
| 1 | VLPSIVILG | 0.180 |
| 38 | GIGGTIPHV | 0.135 |
| 15 | LPCISRKLK | 0.100 |
| 14 | FLPCISRKL | 0.090 |
| 13 | LFLPCISRK | 0.068 |
| 34 | FLEEGIGGT | 0.068 |
| 17 | CISRKLKRI | 0.045 |
| 4 | SIVILGKII | 0.045 |
| 19 | SRKLKRIKK | 0.040 |
| 45 | HVSPERVTV | 0.030 |
| 41 | GTIPHVSPE | 0.020 |
| 27 | KGWEKSQFL | 0.014 |
| 16 | PCISRKLKR | 0.012 |
| 18 | ISRKLKRIK | 0.010 |
| 31 | KSQFLEEGI | 0.009 |
| 26 | KKGWEKSQF | 0.006 |
| 11 | IILFLPCIS | 0.006 |
| 9 | GKIILFLPC | 0.005 |
| 46 | VSPERVTVM | 0.005 |
| 24 | RIKKGWEKS | 0.004 |
| 43 | IPHVSPERV | 0.002 |
| 35 | LEEGIGGTI | 0.001 |
| 32 | SQFLEEGIG | 0.001 |
| 29 | WEKSQFLEE | 0.000 |
| 3 | PSIVILGKI | 0.000 |
| 37 | EGIGGTIPH | 0.000 |
| 28 | GWEKSQFLE | 0.000 |
| 8 | LGKIILFLP | 0.000 |
| 33 | QFLEEGIGG | 0.000 |
| 40 | GGTIPHVSP | 0.000 |

TABLE XII-continued

V6-HLA-A3-9mers-98P4B6
Each peptide is a portion of SEQ ID NO: 13; each start position is specified, the length of peptide is 9 amino acids, and the end position for each peptide is the start position plus eight.

| Start | Subsequence | Score |
|---|---|---|
| 39 | IGGTIPHVS | 0.000 |
| 25 | IKKGWEKSQ | 0.000 |
| 30 | EKSQFLEEG | 0.000 |
| 20 | RKLKRIKKG | 0.000 |
| 36 | EEGIGGTIP | 0.000 |
| 22 | LKRIKKGWE | 0.000 |
| 44 | PHVSPERVT | 0.000 |

TABLE XII

V7A-HLA-A3-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 9 | FLPNGINGI | 0.900 |
| 4 | SLSETFLPN | 0.180 |
| 1 | SPKSLSETF | 0.020 |
| 6 | SETFLPNGI | 0.002 |
| 3 | KSLSETFLP | 0.001 |
| 7 | ETFLPNGIN | 0.001 |
| 5 | LSETFLPNG | 0.000 |
| 8 | TFLPNGING | 0.000 |
| 2 | PKSLSETFL | 0.000 |

TABLE XII

V7B-HLA-A3-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 9 | STLGYVALL | 0.608 |
| 3 | NMAYQQSTL | 0.600 |

TABLE XII-continued

V7B-HLA-A3-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 1 | FLNMAYQQS | 0.040 |
| 7 | QQSTLGYVA | 0.018 |
| 5 | AYQQSTLGY | 0.008 |
| 8 | QSTLGYVAL | 0.003 |
| 6 | YQQSTLGYV | 0.003 |
| 4 | MAYQQSTLG | 0.001 |
| 2 | LNMAYQQST | 0.001 |

TABLE XII

V7C-HLA-A3-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 167 | KLETIILSK | 270.000 |
| 159 | FLGSGTWMK | 60.000 |
| 175 | KLTQEQKSK | 30.000 |
| 31 | GLSEIVLPI | 24.300 |
| 129 | PLWEFLLRL | 4.050 |
| 109 | ALKAANSWR | 4.000 |
| 148 | SLAFTSWSL | 1.800 |
| 5 | ILDLSVEVL | 1.800 |
| 27 | ILRGGLSEI | 1.350 |
| 165 | WMKLETIIL | 1.200 |
| 128 | GPLWEFLLR | 1.080 |
| 57 | AMWTEEAGA | 1.000 |
| 163 | GTWMKLETI | 0.675 |
| 146 | TLSLAFTSW | 0.600 |
| 131 | WEFLLRLLK | 0.600 |
| 21 | KCLGANILR | 0.540 |
| 12 | VLASPAAAW | 0.300 |
| 185 | CMFSLISGS | 0.300 |

TABLE XII-continued

V7C-HLA-A3-
9mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 13 | LASPAAAWK | 0.300 |
| 37 | LPIEWQQDR | 0.270 |
| 126 | GVGPLWEFL | 0.270 |
| 38 | PIEWQQDRK | 0.200 |
| 134 | LLRLLKSQA | 0.200 |
| 173 | LSKLTQEQK | 0.100 |
| 88 | GVVTEDDEA | 0.090 |
| 69 | AQESGIRNK | 0.090 |
| 7 | DLSVEVLAS | 0.072 |
| 2 | SIVILDLSV | 0.060 |
| 136 | RLLKSQAAS | 0.060 |
| 22 | CLGANILRG | 0.060 |
| 151 | FTSWSLGEF | 0.045 |
| 155 | SLGEFLGSG | 0.041 |
| 181 | KSKHCMFSL | 0.041 |
| 125 | NGVGPLWEF | 0.030 |
| 49 | PLSTPPPPA | 0.030 |
| 4 | VILDLSVEV | 0.030 |
| 145 | GTLSLAFTS | 0.027 |
| 42 | QQDRKIPPL | 0.027 |
| 123 | HTNGVGPLW | 0.022 |
| 51 | STPPPPAMW | 0.022 |
| 133 | FLLRLLKSQ | 0.022 |
| 35 | IVLPIEWQQ | 0.020 |
| 36 | VLPIEWQQD | 0.020 |
| 172 | ILSKLTQEQ | 0.020 |
| 143 | ASGTLSLAF | 0.020 |
| 9 | SVEVLASPA | 0.020 |
| 137 | LLKSQAASG | 0.020 |
| 82 | SQIPVVGVV | 0.018 |
| 179 | EQKSKHCMF | 0.018 |
| 59 | WTEEAGATA | 0.015 |
| 83 | QIPVVGVVT | 0.015 |
| 152 | TSWSLGEFL | 0.015 |

TABLE XII-continued

V7C-HLA-A3-
9mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 176 | LTQEQKSKH | 0.015 |
| 73 | GIRNKSSSS | 0.012 |
| 141 | QAASGTLSL | 0.012 |
| 46 | KIPPLSTPP | 0.009 |
| 11 | EVLASPAAA | 0.009 |
| 103 | PESPDRALK | 0.009 |
| 100 | IDPPESPDR | 0.006 |
| 112 | AANSWRNPV | 0.006 |
| 170 | TIILSKLTQ | 0.006 |
| 120 | VLPHTNGVG | 0.006 |
| 66 | TAEAQESGI | 0.006 |
| 26 | NILRGGLSE | 0.006 |
| 127 | VGPLWEFLL | 0.005 |
| 24 | GANILRGGL | 0.005 |
| 142 | AASGTLSLA | 0.005 |
| 81 | SSQIPVVGV | 0.005 |
| 52 | TPPPPAMWT | 0.005 |
| 3 | IVILDLSVE | 0.005 |
| 171 | IILSKLTQE | 0.005 |
| 119 | PVLPHTNGV | 0.005 |
| 99 | SIDPPESPD | 0.005 |
| 168 | LETIILSKL | 0.004 |
| 17 | AAAWKCLGA | 0.004 |
| 67 | AEAQESGIR | 0.004 |
| 108 | RALKAANSW | 0.003 |
| 15 | SPAAAWKCL | 0.003 |
| 86 | VVGVVTEDD | 0.003 |
| 177 | TQEQKSKHC | 0.003 |
| 14 | ASPAAAWKC | 0.003 |
| 89 | VVTEDDEAQ | 0.003 |
| 154 | WSLGEFLGS | 0.003 |
| 139 | KSQAASGTL | 0.003 |
| 157 | GEFLGSGTW | 0.003 |

TABLE XII-continued

V7C-HLA-A3-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 50 | LSTPPPPAM | 0.002 |
| 34 | EIVLPIEWQ | 0.002 |
| 85 | PVVGVVTED | 0.002 |
| 78 | SSSSSQIPV | 0.002 |
| 182 | SKHCMFSLI | 0.002 |
| 160 | LGSGTWMKL | 0.002 |
| 115 | SWRNPVLPH | 0.002 |
| 33 | SEIVLPIEW | 0.002 |
| 79 | SSSSQIPVV | 0.002 |
| 105 | SPDRALKAA | 0.002 |
| 65 | ATAEAQESG | 0.002 |
| 64 | GATAEAQES | 0.001 |
| 29 | RGGLSEIVL | 0.001 |
| 113 | ANSWRNPVL | 0.001 |
| 140 | SQAASGTLS | 0.001 |

TABLE XIII

V1-HLA-A3-10-98P4B6
Each peptide is a portion of SEQ ID NO: 3; each start position is specified, the length of peptide is 10 amino acids, and the end position for each peptide is the start position plus nine.

| Start | Subsequence | Score |
|---|---|---|
| 135 | SLFPDSLIVK | 450.000 |
| 281 | QLYYGTKYRR | 60.000 |
| 34 | GVIGSGDFAK | 40.500 |
| 275 | LLAAAYQLYY | 24.000 |
| 294 | WLETWLQCRK | 20.000 |
| 274 | GLLAAAYQLY | 18.000 |
| 17 | CLPNGINGIK | 9.000 |
| 21 | GINGIKDARK | 9.000 |
| 306 | GLLSFFFAMV | 8.100 |
| 271 | YLAGLLAAAY | 6.000 |

TABLE XIII-continued

V1-HLA-A3-10-98P4B6
Each peptide is a portion of SEQ ID NO: 3; each start position is specified, the length of peptide is 10 amino acids, and the end position for each peptide is the start position plus nine.

| Start | Subsequence | Score |
|---|---|---|
| 112 | ILIDVSNNMR | 6.000 |
| 443 | ILDLLQLCRY | 6.000 |
| 227 | FLYSFVRDVI | 4.500 |
| 210 | TLWRGPVVVA | 4.500 |
| 322 | CLPMRRSERY | 4.000 |
| 55 | HVVIGSRNPK | 3.000 |
| 402 | ALLISTFHVL | 2.700 |
| 266 | LLSLVYLAGL | 2.700 |
| 403 | LLISTFHVLI | 2.700 |
| 437 | VLPSIVILDL | 2.700 |
| 404 | LISTFHVLIY | 2.400 |
| 107 | LLVGKILIDV | 2.025 |
| 100 | SLWDLRHLLV | 2.000 |
| 76 | VTHHEDALTK | 2.000 |
| 370 | LLSLLAVTSI | 1.800 |
| 132 | YLASLFPDSL | 1.800 |
| 304 | QLGLLSFFFA | 1.800 |
| 385 | ALNWREFSFI | 1.800 |
| 435 | ALVLPSIVIL | 1.350 |
| 303 | KQLGLLSFFF | 1.215 |
| 307 | LLSFFFAMVH | 1.200 |
| 442 | VILDLLQLCR | 1.200 |
| 298 | WLQCRKQLGL | 1.200 |
| 365 | IMSLGLLSLL | 0.900 |
| 410 | VLIYGWKRAF | 0.900 |
| 140 | SLIVKGFNVV | 0.900 |
| 207 | RLFTLWRGPV | 0.900 |
| 258 | TLPIVAITLL | 0.900 |
| 123 | NQYPESNAEY | 0.900 |
| 278 | AAYQLYYGTK | 0.900 |
| 364 | GIMSLGLLSL | 0.810 |
| 427 | YTPPNFVLAL | 0.810 |
| 220 | ISLATFFFLY | 0.810 |
| 221 | SLATFFFLYS | 0.720 |

TABLE XIII-continued

V1-HLA-A3-
10-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 257 | KTLPIVAITL | 0.608 |
| 333 | FLNMAYQQVH | 0.600 |
| 268 | SLVYLAGLLA | 0.600 |
| 324 | PMRRSERYLF | 0.600 |
| 82 | ALTKTNIIFV | 0.600 |
| 367 | SLGLLSLLAV | 0.600 |
| 203 | NLPLRLFTLW | 0.600 |
| 166 | YICSNNIQAR | 0.600 |
| 219 | AISLATFFFL | 0.540 |
| 147 | NVVSAWALQL | 0.540 |
| 150 | SAWALQLGPK | 0.450 |
| 56 | VVIGSRNPKF | 0.450 |
| 417 | RAFEEEYYRF | 0.450 |
| 45 | LTIRLIRCGY | 0.450 |
| 216 | VVVAISLATF | 0.450 |
| 178 | VIELARQLNF | 0.400 |
| 204 | LPLRLFTLWR | 0.360 |
| 358 | EMYISFGIMS | 0.360 |
| 314 | MVHVAYSLCL | 0.360 |
| 48 | RLIRCGYHVV | 0.300 |
| 317 | VAYSLCLPMR | 0.300 |
| 331 | YLFLNMAYQQ | 0.300 |
| 313 | AMVHVAYSLC | 0.300 |
| 373 | LLAVTSIPSV | 0.300 |
| 269 | LVYLAGLLAA | 0.300 |
| 440 | SIVILDLLQL | 0.270 |
| 222 | LATFFFLYSF | 0.270 |
| 154 | LQLGPKDASR | 0.270 |
| 85 | KTNIIFVAIH | 0.270 |
| 356 | RIEMYISFGI | 0.270 |
| 406 | STFHVLIYGW | 0.225 |
| 396 | STLGYVALLI | 0.203 |
| 432 | FVLALVLPSI | 0.203 |

TABLE XIII-continued

V1-HLA-A3-
10-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 217 | VVAISLATFF | 0.200 |
| 433 | VLALVLPSIV | 0.200 |
| 391 | FSFIQSTLGY | 0.200 |
| 369 | GLLSLLAVTS | 0.180 |
| 224 | TFFFLYSFVR | 0.180 |
| 49 | LIRCGYHVVI | 0.180 |
| 103 | DLRHLLVGKI | 0.162 |
| 111 | KILIDVSNNM | 0.135 |
| 249 | KIPIEIVNKT | 0.135 |
| 264 | ITLLSLVYLA | 0.135 |
| 5 | SMMGSPKSLS | 0.135 |
| 113 | LIDVSNNMRI | 0.120 |
| 262 | VAITLLSLVY | 0.120 |
| 372 | SLLAVTSIPS | 0.120 |
| 397 | TLGYVALLIS | 0.120 |
| 157 | GPKDASRQVY | 0.120 |
| 172 | IQARQQVIEL | 0.108 |
| 243 | QQSDFYKIPI | 0.108 |
| 347 | NSWNEEEVWR | 0.100 |
| 39 | GDFAKSLTIR | 0.090 |
| 218 | VAISLATFFF | 0.090 |
| 384 | NALNWREFSF | 0.090 |
| 285 | GTKYRRFPPW | 0.090 |

TABLE XIII

V2-HLA-A3-
10mers-98P4B6
Each peptide is a portion of
SEQ ID NO: 5; each start
position is specified, the
length of peptide is 10 amino
acids, and the end position
for each peptide is the start
position plus nine.

| Start | Subsequence | Score |
|---|---|---|
| 22 | CLSLPSSWDY | 12.000 |
| 8 | ALSLSLSSGF | 2.000 |

TABLE XIII-continued

V2-HLA-A3-
10mers-98P4B6
Each peptide is a portion of
SEQ ID NO: 5; each start
position is specified, the
length of peptide is 10 amino
acids, and the end position
for each peptide is the start
position plus nine.

| Start | Subsequence | Score |
|---|---|---|
| 24 | SLPSSWDYRC | 1.800 |
| 5 | GLQALSLSLS | 0.180 |
| 12 | SLSSGFTPFS | 0.120 |
| 10 | SLSLSSGFTP | 0.060 |
| 35 | PPCPADFFLY | 0.054 |
| 11 | LSLSSGFTPF | 0.045 |
| 23 | LSLPSSWDYR | 0.045 |
| 33 | CPPPCPADFF | 0.045 |
| 36 | PCPADFFLYF | 0.036 |
| 32 | RCPPPCPADF | 0.030 |
| 2 | GSPGLQALSL | 0.027 |
| 14 | SSGFTPFSCL | 0.013 |
| 16 | GFTPFSCLSL | 0.005 |
| 13 | LSSGFTPFSC | 0.005 |
| 18 | TPFSCLSLPS | 0.004 |
| 6 | LQALSLSLSS | 0.002 |
| 34 | PPPCPADFFL | 0.002 |
| 17 | FTPFSCLSLP | 0.002 |
| 20 | FSCLSLPSSW | 0.001 |
| 3 | SPGLQALSLS | 0.001 |
| 15 | SGFTPFSCLS | 0.001 |
| 27 | SSWDYRCPPP | 0.001 |
| 21 | SCLSLPSSWD | 0.000 |
| 7 | QALSLSLSSG | 0.000 |
| 9 | LSLSLSSGFT | 0.000 |
| 28 | SWDYRCPPPC | 0.000 |
| 4 | PGLQALSLSL | 0.000 |
| 29 | WDYRCPPPCP | 0.000 |
| 30 | DYRCPPPCPA | 0.000 |
| 1 | SGSPGLQALS | 0.000 |
| 31 | YRCPPPCPAD | 0.000 |
| 26 | PSSWDYRCPP | 0.000 |

TABLE XIII-continued

V2-HLA-A3-
10mers-98P4B6
Each peptide is a portion of
SEQ ID NO: 5; each start
position is specified, the
length of peptide is 10 amino
acids, and the end position
for each peptide is the start
position plus nine.

| Start | Subsequence | Score |
|---|---|---|
| 25 | LPSSWDYRCP | 0.000 |
| 19 | PFSCLSLPSS | 0.000 |

TABLE XIII

V5A-HLA-A3-
10mers-98P4B6
Each peptide is a portion of
SEQ ID NO: 11; each start
position is specified, the
length of peptide is 10 amino
acids, and the end position
for each peptide is the start
position plus nine.

| Start | Subsequence | Score |
|---|---|---|
| 6 | RLFTFWRGPV | 0.900 |
| 2 | NLPLRLFTFW | 0.600 |
| 3 | LPLRLFTFWR | 0.540 |
| 8 | FTFWRGPVVV | 0.050 |
| 4 | PLRLFTFWRG | 0.018 |
| 1 | ENLPLRLFTF | 0.012 |
| 9 | TFWRGPVVVA | 0.005 |
| 10 | FWRGPVVVAI | 0.004 |
| 7 | LFTFWRGPVV | 0.000 |
| 5 | LRLFTFWRGP | 0.000 |

TABLE XIII

V5B-HLA-A3-
10mers-98P4B6
Each peptide is a portion of
SEQ ID NO: 11; each start
position is specified, the
length of peptide is 10 amino
acids, and the end position
for each peptide is the start
position plus nine.

| Start | Subsequence | Score |
|---|---|---|
| 20 | ELELEFVFLL | 4.860 |
| 22 | ELEFVFLLTL | 1.620 |
| 18 | QTELELEFVF | 0.300 |
| 5 | FSFIQIFCSF | 0.225 |
| 16 | DTQTELELEF | 0.060 |

TABLE XIII-continued

V5B-HLA-A3-
10mers-98P4B6
Each peptide is a portion of
SEQ ID NO: 11; each start
position is specified, the
length of peptide is 10 amino
acids, and the end position
for each peptide is the start
position plus nine.

| Start | Subsequence | Score |
|---|---|---|
| 9 | QIFCSFADTQ | 0.030 |
| 12 | CSFADTQTEL | 0.015 |
| 8 | IQIFCSFADT | 0.013 |
| 23 | LEFVLLTLL | 0.013 |
| 17 | TQTELELEFV | 0.013 |
| 19 | TELELEFVFL | 0.012 |
| 14 | FADTQTELEL | 0.012 |
| 2 | WREFSFIQIF | 0.009 |
| 3 | REFSFIQIFC | 0.009 |
| 21 | LELEFVFLLT | 0.006 |
| 7 | FIQIFCSFAD | 0.006 |
| 1 | NWREFSFIQI | 0.005 |
| 6 | SFIQIFCSFA | 0.001 |
| 24 | EFVFLLTLLL | 0.001 |
| 11 | FCSFADTQTE | 0.000 |
| 10 | IFCSFADTQT | 0.000 |
| 4 | EFSFIQIFCS | 0.000 |
| 15 | ADTQTELELE | 0.000 |
| 13 | SFADTQTELE | 0.000 |

TABLE XIII

V6-HLA-A3-
10mers-98P4B6
Each peptide is a portion of
SEQ ID NO: 13; each start
position is specified, the
length of peptide is 10 amino
acids, and the end position
for each peptide is the start
position plus nine.

| Start | Subsequence | Score |
|---|---|---|
| 13 | ILFLPCISRK | 150.000 |
| 2 | VLPSIVILGK | 90.000 |
| 15 | FLPCISRKLK | 10.000 |
| 42 | GTIPHVSPER | 2.025 |
| 12 | IILFLPCISR | 1.800 |
| 6 | IVILGKIILF | 0.900 |

TABLE XIII-continued

V6-HLA-A3-
10mers-98P4B6
Each peptide is a portion of
SEQ ID NO: 13; each start
position is specified, the
length of peptide is 10 amino
acids, and the end position
for each peptide is the start
position plus nine.

| Start | Subsequence | Score |
|---|---|---|
| 7 | VILGKIILFL | 0.608 |
| 35 | FLEEGIGGTI | 0.405 |
| 19 | ISRKLKRIKK | 0.200 |
| 18 | CISRKLKRIK | 0.200 |
| 5 | SIVILGKIIL | 0.180 |
| 8 | ILGKIILFLP | 0.135 |
| 46 | HVSPERVTVM | 0.090 |
| 16 | LPCISRKLKR | 0.080 |
| 23 | LKRIKKGWEK | 0.060 |
| 1 | LVLPSIVILG | 0.041 |
| 39 | GIGGTIPHVS | 0.027 |
| 43 | TIPHVSPERV | 0.020 |
| 22 | KLKRIKKGWE | 0.018 |
| 11 | KIILFLPCIS | 0.018 |
| 10 | GKIILFLPCI | 0.012 |
| 33 | SQFLEEGIGG | 0.006 |
| 3 | LPSIVILGKI | 0.004 |
| 26 | IKKGWEKSQF | 0.003 |
| 25 | RIKKGWEKSQ | 0.003 |
| 27 | KKGWEKSQFL | 0.002 |
| 28 | KGWEKSQFLE | 0.001 |
| 9 | LGKIILFLPC | 0.001 |
| 17 | PCISRKLKRI | 0.001 |
| 29 | GWEKSQFLEE | 0.000 |
| 37 | EEGIGGTIPH | 0.000 |
| 30 | WEKSQFLEEG | 0.000 |
| 21 | RKLKRIKKGW | 0.000 |
| 4 | PSIVILGKII | 0.000 |
| 38 | EGIGGTIPHV | 0.000 |
| 14 | LFLPCISRKL | 0.000 |
| 41 | GGTIPHVSPE | 0.000 |
| 24 | KRIKKGWEKS | 0.000 |
| 31 | EKSQFLEEGI | 0.000 |

TABLE XIII-continued

V6-HLA-A3-10mers-98P4B6

Each peptide is a portion of SEQ ID NO: 13; each start position is specified, the length of peptide is 10 amino acids, and the end position for each peptide is the start position plus nine.

| Start | Subsequence | Score |
|---|---|---|
| 44 | IPHVSPERVT | 0.000 |
| 34 | QFLEEGIGGT | 0.000 |
| 32 | KSQFLEEGIG | 0.000 |
| 36 | LEEGIGGTIP | 0.000 |
| 45 | PHVSPERVTV | 0.000 |
| 40 | IGGTIPHVSP | 0.000 |
| 20 | SRKLKRIKKG | 0.000 |

TABLE XIII

V7A-HLA-A3-10mers-98P4B6

Each peptide is a portion of SEQ ID NO: 15; each start position is specified, the length of peptide is 10 amino acids, and the end position for each peptide is the start position plus nine.

| Start | Subsequence | Score |
|---|---|---|
| 10 | FLPNGINGIK | 9.000 |
| 5 | SLSETFLPNG | 0.135 |
| 1 | GSPKSLSETF | 0.030 |
| 2 | SPKSLSETFL | 0.006 |
| 6 | LSETFLPNGI | 0.003 |
| 8 | ETFLPNGING | 0.003 |
| 4 | KSLSETFLPN | 0.003 |
| 9 | TFLPNGINGI | 0.002 |
| 7 | SETFLPNGIN | 0.000 |
| 3 | PKSLSETFLP | 0.000 |

TABLE XIII

V7B-HLA-A3-10mers-98P4B6

Each peptide is a portion of SEQ ID NO: 15; each start position is specified, the length of peptide is 10 amino acids, and the end position for each peptide is the start position plus nine.

| Start | Subsequence | Score |
|---|---|---|
| 5 | MAYQQSTLGY | 0.400 |
| 2 | FLNMAYQQST | 0.300 |
| 10 | STLGYVALLI | 0.203 |
| 9 | QSTLGYVALL | 0.027 |
| 4 | NMAYQQSTLG | 0.020 |
| 7 | YQQSTLGYVA | 0.018 |
| 8 | QQSTLGYVAL | 0.018 |
| 3 | LNMAYQQSTL | 0.002 |
| 6 | AYQQSTLGYV | 0.000 |
| 1 | LFLNMAYQQS | 0.000 |

TABLE XIII

V7C-HLA-A3-10mers-98P4B6

Each peptide is a portion of SEQ ID NO: 15; each start position is specified, the length of peptide is 10 amino acids, and the end position for each peptide is the start position plus nine.

| Start | Subsequence | Score |
|---|---|---|
| 13 | VLASPAAAWK | 20.000 |
| 173 | ILSKLTQEQK | 20.000 |
| 37 | VLPIEWQQDR | 12.000 |
| 168 | KLETIILSKL | 4.050 |
| 127 | GVGPLWEFLL | 2.430 |
| 160 | FLGSGTWMKL | 1.200 |
| 100 | SIDPPESPDR | 0.600 |
| 176 | KLTQEQKSKH | 0.600 |
| 38 | LPIEWQQDRK | 0.450 |
| 164 | GTWMKLETII | 0.450 |
| 134 | FLLRLLKSQA | 0.300 |
| 6 | ILDLSVEVLA | 0.300 |
| 28 | ILRGGLSEIV | 0.300 |
| 5 | VILDLSVEVL | 0.270 |
| 129 | GPLWEFLLRL | 0.243 |

TABLE XIII-continued

V7C-HLA-A3-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 167 | MKLETIILSK | 0.203 |
| 32 | GLSEIVLPIE | 0.203 |
| 135 | LLRLLKSQAA | 0.200 |
| 156 | SLGEFLGSGT | 0.150 |
| 58 | AMWTEEAGAT | 0.150 |
| 146 | GTLSLAFTSW | 0.135 |
| 27 | NILRGGLSEI | 0.135 |
| 166 | WMKLETIILS | 0.120 |
| 147 | TLSLAFTSWS | 0.120 |
| 138 | LLKSQAASGT | 0.100 |
| 130 | PLWEFLLRLL | 0.068 |
| 143 | AASGTLSLAF | 0.060 |
| 110 | ALKAANSWRN | 0.060 |
| 109 | RALKAANSWR | 0.060 |
| 66 | ATAEAQESGI | 0.045 |
| 115 | NSWRNPVLPH | 0.045 |
| 159 | EFLGSGTWMK | 0.041 |
| 131 | LWEFLLRLLK | 0.040 |
| 141 | SQAASGTLSL | 0.036 |
| 152 | FTSWSLGEFL | 0.030 |
| 50 | PLSTPPPPAM | 0.030 |
| 137 | RLLKSQAASG | 0.030 |
| 4 | IVILDLSVEV | 0.030 |
| 19 | AAWKCLGANI | 0.030 |
| 125 | TNGVGPLWEF | 0.027 |
| 42 | WQQDRKIPPL | 0.027 |
| 182 | KSKHCMFSLI | 0.027 |
| 31 | GGLSEIVLPI | 0.024 |
| 128 | VGPLWEFLLR | 0.024 |
| 52 | STPPPPAMWT | 0.022 |
| 103 | PPESPDRALK | 0.020 |
| 10 | SVEVLASPAA | 0.020 |
| 149 | SLAFTSWSLG | 0.020 |
| 121 | VLPHTNGVGP | 0.020 |

TABLE XIII-continued

V7C-HLA-A3-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 112 | KAANSWRNPV | 0.018 |
| 175 | SKLTQEQKSK | 0.015 |
| 148 | LSLAFTSWSL | 0.013 |
| 12 | EVLASPAAAW | 0.013 |
| 8 | DLSVEVLASP | 0.013 |
| 69 | EAQESGIRNK | 0.013 |
| 74 | GIRNKSSSSS | 0.012 |
| 67 | TAEAQESGIR | 0.012 |
| 83 | SQIPVVGVVT | 0.010 |
| 89 | GVVTEDDEAQ | 0.009 |
| 47 | KIPPLSTPPP | 0.009 |
| 14 | LASPAAAWKC | 0.009 |
| 158 | GEFLGSGTWM | 0.009 |
| 21 | WKCLGANILR | 0.008 |
| 177 | LTQEQKSKHC | 0.007 |
| 179 | QEQKSKHCMF | 0.006 |
| 113 | AANSWRNPVL | 0.006 |
| 84 | QIPVVGVVTE | 0.006 |
| 178 | TQEQKSKHCM | 0.006 |
| 150 | LAFTSWSLGE | 0.006 |
| 78 | KSSSSSQIPV | 0.006 |
| 122 | LPHTNGVGPL | 0.005 |
| 3 | SIVILDLSVE | 0.005 |
| 36 | IVLPIEWQQD | 0.005 |
| 23 | CLGANILRGG | 0.005 |
| 171 | TIILSKLTQE | 0.005 |
| 81 | SSSQIPVVGV | 0.005 |
| 22 | KCLGANILRG | 0.004 |
| 35 | EIVLPIEWQQ | 0.004 |
| 119 | NPVLPHTNGV | 0.003 |
| 162 | GSGTWMKLET | 0.003 |
| 142 | QAASGTLSLA | 0.003 |
| 124 | HTNGVGPLWE | 0.003 |

TABLE XIII-continued

V7C-HLA-A3-10mers-98P4B6
Each peptide is a portion of SEQ ID NO: 15; each start position is specified, the length of peptide is 10 amino acids, and the end position for each peptide is the start position plus nine.

| Start | Subsequence | Score |
|---|---|---|
| 90 | VVTEDDEAQD | 0.003 |
| 172 | IILSKLTQEQ | 0.003 |
| 181 | QKSKHCMFSL | 0.003 |
| 9 | LSVEVLASPA | 0.002 |
| 51 | LSTPPPPAMW | 0.002 |
| 87 | VVGVVTEDDE | 0.002 |
| 33 | LSEIVLPIEW | 0.002 |
| 91 | VTEDDEAQDS | 0.002 |
| 165 | TWMKLETIIL | 0.002 |
| 29 | LRGGLSEIVL | 0.002 |
| 70 | AQESGIRNKS | 0.002 |
| 132 | WEFLLRLLKS | 0.002 |
| 43 | QQDRKIPPLS | 0.002 |
| 92 | TEDDEAQDSI | 0.002 |
| 79 | SSSSSQIPVV | 0.002 |
| 60 | WTEEAGATAE | 0.002 |
| 153 | TSWSLGEFLG | 0.002 |
| 15 | ASPAAAWKCL | 0.002 |

TABLE XIV

V1-HLA-A1101-9mers-98P4B6
Each peptide is a portion of SEQ ID NO: 3; each start position is specified, the length of peptide is 9 amino acids, and the end position for each peptide is the start position plus eight.

| Start | Subsequence | Score |
|---|---|---|
| 56 | VVIGSRNPK | 3.000 |
| 409 | HVLIYGWKR | 1.200 |
| 249 | KIPIEIVNK | 1.200 |
| 35 | VIGSGDFAK | 1.200 |
| 175 | RQQVIELAR | 0.720 |
| 417 | RAFEEEYYR | 0.480 |
| 3 | SISMMGSPK | 0.400 |

TABLE XIV-continued

V1-HLA-A1101-9mers-98P4B6
Each peptide is a portion of SEQ ID NO: 3; each start position is specified, the length of peptide is 9 amino acids, and the end position for each peptide is the start position plus eight.

| Start | Subsequence | Score |
|---|---|---|
| 279 | AYQLYYGTK | 0.400 |
| 136 | LFPDSLIVK | 0.400 |
| 381 | SVSNALNWR | 0.400 |
| 241 | RNQQSDFYK | 0.360 |
| 282 | LYYGTKYRR | 0.320 |
| 225 | FFFLYSFVR | 0.240 |
| 21 | GINGIKDAR | 0.240 |
| 53 | GYHVVIGSR | 0.240 |
| 87 | NIIFVAIHR | 0.240 |
| 18 | LPNGINGIK | 0.200 |
| 443 | ILDLLQLCR | 0.160 |
| 103 | DLRHLLVGK | 0.120 |
| 34 | GVIGSGDFA | 0.090 |
| 322 | CLPMRRSER | 0.080 |
| 113 | LIDVSNNMR | 0.080 |
| 155 | QLGPKDASR | 0.080 |
| 318 | AYSLCLPMR | 0.080 |
| 269 | LVYLAGLLA | 0.080 |
| 281 | QLYYGTKYR | 0.080 |
| 294 | WLETWLQCR | 0.080 |
| 97 | HYTSLWDLR | 0.080 |
| 295 | LETWLQCRK | 0.060 |
| 441 | IVILDLLQL | 0.060 |
| 306 | GLLSFFFAM | 0.054 |
| 199 | REIENLPLR | 0.054 |
| 22 | INGIKDARK | 0.040 |
| 148 | VVSAWALQL | 0.040 |
| 77 | THHEDALTK | 0.040 |
| 108 | LVGKILIDV | 0.040 |
| 223 | ATFFFLYSF | 0.040 |
| 261 | IVAITLLSL | 0.040 |
| 167 | ICSNNIQAR | 0.040 |
| 164 | QVYICSNNI | 0.040 |
| 43 | KSLTIRLIR | 0.036 |

TABLE XIV-continued

V1-HLA-A1101-
9mers-98P4B6
Each peptide is a portion of
SEQ ID NO: 3; each start
position is specified, the
length of peptide is 9 amino
acids, and the end position
for each peptide is the start
position plus eight.

| Start | Subsequence | Score |
|---|---|---|
| 233 | RDVIHPYAR | 0.036 |
| 48 | RLIRCGYHV | 0.036 |
| 274 | GLLAAAYQL | 0.036 |
| 330 | RYLFLNMAY | 0.036 |
| 408 | FHVLIYGWK | 0.030 |
| 85 | KTNIIFVAI | 0.030 |
| 436 | LVLPSIVIL | 0.030 |
| 303 | KQLGLLSFF | 0.027 |
| 353 | EVWRIEMYI | 0.024 |
| 191 | DLGSLSSAR | 0.024 |
| 254 | IVNKTLPIV | 0.020 |
| 90 | FVAIHREHY | 0.020 |
| 151 | AWALQLGPK | 0.020 |
| 83 | LTKTNIIFV | 0.020 |
| 98 | YTSLWDLRH | 0.020 |
| 231 | FVRDVIHPY | 0.020 |
| 400 | YVALLISTF | 0.020 |
| 217 | VVAISLATF | 0.020 |
| 402 | ALLISTFHV | 0.018 |
| 64 | KFASEFFPH | 0.018 |
| 140 | SLIVKGFNV | 0.018 |
| 214 | GPVVVAISL | 0.018 |
| 135 | SLFPDSLIV | 0.016 |
| 205 | PLRLFTLWR | 0.016 |
| 209 | FTLWRGPVV | 0.015 |
| 264 | ITLLSLVYL | 0.015 |
| 396 | STLGYVALL | 0.015 |
| 319 | YSLCLPMRR | 0.012 |
| 394 | IQSTLGYVA | 0.012 |
| 30 | KVTVGVIGS | 0.012 |
| 270 | VYLAGLLAA | 0.012 |
| 203 | NLPLRLFTL | 0.012 |
| 425 | RFYTPPNFV | 0.012 |

TABLE XIV-continued

V1-HLA-A1101-
9mers-98P4B6
Each peptide is a portion of
SEQ ID NO: 3; each start
position is specified, the
length of peptide is 9 amino
acids, and the end position
for each peptide is the start
position plus eight.

| Start | Subsequence | Score |
|---|---|---|
| 242 | NQQSDFYKI | 0.012 |
| 287 | KYRRFPPWL | 0.012 |
| 453 | ALVLPSIVI | 0.012 |
| 265 | TLLSLVYLA | 0.012 |
| 299 | LQCRKQLGL | 0.012 |
| 313 | AMVHVAYSL | 0.012 |
| 40 | DFAKSLTIR | 0.012 |
| 106 | HLLVGKILI | 0.012 |
| 426 | FYTPPNFVL | 0.012 |
| 385 | ALNWREFSF | 0.012 |
| 219 | AISLATFFF | 0.012 |
| 304 | QLGLLSFFF | 0.012 |
| 221 | SLATFFFLY | 0.012 |
| 427 | YTPPNFVLA | 0.010 |
| 285 | GTKYRRFPP | 0.009 |
| 280 | YQLYYGTKY | 0.009 |
| 397 | TLGYVALLI | 0.008 |
| 367 | SLGLLSLLA | 0.008 |
| 166 | YICSNNIQA | 0.008 |
| 258 | TLPIVAITL | 0.008 |
| 317 | VAYSLCLPM | 0.008 |
| 100 | SLWDLRHLL | 0.008 |
| 210 | TLWRGPVVV | 0.008 |
| 365 | IMSLGLLSL | 0.008 |
| 263 | AITLLSLVY | 0.008 |
| 360 | YISFGIMSL | 0.008 |

TABLE XIV

V2-HLA-A1101-9mers-98P4B6

Each peptide is a portion of SEQ ID NO: 5; each start position is specified, the length of peptide is 9 amino acids, and the end position for each peptide is the start position plus eight.

| Start | Subsequence | Score |
|---|---|---|
| 24 | SLPSSWDYR | 0.080 |
| 5 | GLQALSLSL | 0.024 |
| 17 | FTPFSCLSL | 0.020 |
| 3 | SPGLQALSL | 0.004 |
| 12 | SLSSGFTPF | 0.004 |
| 37 | CPADFFLYF | 0.004 |
| 21 | SCLSLPSSW | 0.003 |
| 33 | CPPPCPADF | 0.002 |
| 23 | LSLPSSWDY | 0.001 |
| 6 | LQALSLSLS | 0.001 |
| 16 | GFTPFSCLS | 0.001 |
| 32 | RCPPPCPAD | 0.001 |
| 36 | PCPADFFLY | 0.001 |
| 35 | PPCPADFFL | 0.001 |
| 7 | QALSLSLSS | 0.001 |
| 10 | SLSLSSGFT | 0.000 |
| 15 | SGFTPFSCL | 0.000 |
| 22 | CLSLPSSWD | 0.000 |
| 8 | ALSLSLSSG | 0.000 |
| 18 | TPFSCLSLP | 0.000 |
| 25 | LPSSWDYRC | 0.000 |
| 9 | LSLSLSSGF | 0.000 |
| 1 | SGSPGLQAL | 0.000 |
| 31 | YRCPPPCPA | 0.000 |
| 34 | PPPCPADFF | 0.000 |
| 30 | DYRCPPPCP | 0.000 |
| 11 | LSLSSGFTP | 0.000 |
| 14 | SSGFTPFSC | 0.000 |
| 2 | GSPGLQALS | 0.000 |
| 19 | PFSCLSLPS | 0.000 |
| 29 | WDYRCPPPC | 0.000 |
| 27 | SSWDYRCPP | 0.000 |
| 13 | LSSGFTPFS | 0.000 |
| 20 | FSCLSLPSS | 0.000 |

TABLE XIV-continued

V2-HLA-A1101-9mers-98P4B6

Each peptide is a portion of SEQ ID NO: 5; each start position is specified, the length of peptide is 9 amino acids, and the end position for each peptide is the start position plus eight.

| Start | Subsequence | Score |
|---|---|---|
| 28 | SWDYRCPPP | 0.000 |
| 4 | PGLQALSLS | 0.000 |
| 26 | PSSWDYRCP | 0.000 |

TABLE XIV

V5A-HLA-A1101-9mers-98P4B6

Each peptide is a portion of SEQ ID NO: 11; each start position is specified, the length of peptide is 9 amino acids, and the end position for each peptide is the start position plus eight.

| Start | Subsequence | Score |
|---|---|---|
| 3 | PLRLFTFWR | 0.024 |
| 7 | FTFWRGPVV | 0.020 |
| 1 | NLPLRLFTF | 0.012 |
| 8 | TFWRGPVVV | 0.004 |
| 2 | LPLRLFTFW | 0.003 |
| 6 | LFTFWRGPV | 0.002 |
| 5 | RLFTFWRGP | 0.000 |
| 9 | FWRGPVVVA | 0.000 |
| 4 | LRLFTFWRG | 0.000 |

TABLE XIV

V5B-HLA-A11-9mers-98P4B6

Each peptide is a portion of SEQ ID NO: 11; each start position is specified, the length of peptide is 9 amino acids, and the end position for each peptide is the start position plus eight.

| Start | Subsequence | Score |
|---|---|---|
| 24 | FVFLLTLLL | 0.080 |
| 16 | TQTELELEF | 0.012 |
| 17 | QTELELEFV | 0.010 |
| 6 | FIQIFCSFA | 0.004 |
| 2 | REFSFIQIF | 0.004 |

TABLE XIV-continued

V5B-HLA-A11-
9mers-98P4B6
Each peptide is a portion of
SEQ ID NO: 11; each start
position is specified, the
length of peptide is 9 amino
acids, and the end position
for each peptide is the start
position plus eight.

| Start | Subsequence | Score |
|---|---|---|
| 5 | SFIQIFCSF | 0.003 |
| 7 | IQIFCSFAD | 0.003 |
| 18 | TELELEFVF | 0.003 |
| 20 | LELEFVFLL | 0.003 |
| 22 | LEFVFLLTL | 0.002 |
| 12 | SFADTQTEL | 0.002 |
| 19 | ELELEFVFL | 0.001 |
| 23 | EFVFLLTLL | 0.001 |
| 8 | QIFCSFADT | 0.001 |
| 14 | ADTQTELEL | 0.000 |
| 1 | WREFSFIQI | 0.000 |
| 15 | DTQTELELE | 0.000 |
| 21 | ELEFVFLLT | 0.000 |
| 9 | IFCSFADTQ | 0.000 |
| 13 | FADTQTELE | 0.000 |
| 10 | FCSFADTQT | 0.000 |
| 4 | FSFIQIFCS | 0.000 |
| 3 | EFSFIQIFC | 0.000 |
| 11 | CSFADTQTE | 0.000 |

TABLE XIV

V6-HLA-A1101-
9mers-98P4B6
Each peptide is a portion of
SEQ ID NO: 13; each start
position is specified, the
length of peptide is 9 amino
acids, and the end position
for each peptide is the start
position plus eight.

| Start | Subsequence | Score |
|---|---|---|
| 2 | LPSIVILGK | 0.400 |
| 12 | ILFLPCISR | 0.320 |
| 13 | LFLPCISRK | 0.300 |
| 23 | KRIKKGWEK | 0.180 |
| 15 | LPCISRKLK | 0.100 |
| 42 | TIPHVSPER | 0.080 |

TABLE XIV-continued

V6-HLA-A1101-
9mers-98P4B6
Each peptide is a portion of
SEQ ID NO: 13; each start
position is specified, the
length of peptide is 9 amino
acids, and the end position
for each peptide is the start
position plus eight.

| Start | Subsequence | Score |
|---|---|---|
| 5 | IVILGKIIL | 0.060 |
| 19 | SRKLKRIKK | 0.040 |
| 45 | HVSPERVTV | 0.020 |
| 10 | KIILFLPCI | 0.018 |
| 16 | PCISRKLKR | 0.012 |
| 6 | VILGKIILF | 0.012 |
| 38 | GIGGTIPHV | 0.012 |
| 7 | ILGKIILFL | 0.008 |
| 21 | KLKRIKKGW | 0.006 |
| 41 | GTIPHVSPE | 0.005 |
| 4 | SIVILGKII | 0.003 |
| 18 | ISRKLKRIK | 0.002 |
| 17 | CISRKLKRI | 0.002 |
| 43 | IPHVSPERV | 0.002 |
| 32 | SQFLEEGIG | 0.001 |
| 24 | RIKKGWEKS | 0.001 |
| 27 | KGWEKSQFL | 0.001 |
| 1 | VLPSIVILG | 0.001 |
| 26 | KKGWEKSQF | 0.001 |
| 11 | IILFLPCIS | 0.001 |
| 33 | QFLEEGIGG | 0.001 |
| 31 | KSQFLEEGI | 0.001 |
| 35 | LEEGIGGTI | 0.001 |
| 14 | FLPCISRKL | 0.000 |
| 34 | FLEEGIGGT | 0.000 |
| 46 | VSPERVTVM | 0.000 |
| 9 | GKIILFLPC | 0.000 |
| 28 | GWEKSQFLE | 0.000 |
| 37 | EGIGGTIPH | 0.000 |
| 29 | WEKSQFLEE | 0.000 |
| 8 | LGKIILFLP | 0.000 |
| 40 | GGTIPHVSP | 0.000 |
| 20 | RKLKRIKKG | 0.000 |

TABLE XIV-continued

V6-HLA-A1101-9mers-98P4B6
Each peptide is a portion of SEQ ID NO: 13; each start position is specified, the length of peptide is 9 amino acids, and the end position for each peptide is the start position plus eight.

| Start | Subsequence | Score |
|---|---|---|
| 3 | PSIVILGKI | 0.000 |
| 22 | LKRIKKGWE | 0.000 |
| 39 | IGGTIPHVS | 0.000 |
| 36 | EEGIGGTIP | 0.000 |
| 25 | IKKGWEKSQ | 0.000 |
| 30 | EKSQFLEEG | 0.000 |
| 44 | PHVSPERVT | 0.000 |

TABLE XIV

V7A-HLA-A1101-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 9 | FLPNGINGI | 0.004 |
| 1 | SPKSLSETF | 0.002 |
| 4 | SLSETFLPN | 0.001 |
| 7 | ETFLPNGIN | 0.001 |
| 8 | TFLPNGING | 0.001 |
| 6 | SETFLPNGI | 0.001 |
| 3 | KSLSETFLP | 0.000 |
| 2 | PKSLSETFL | 0.000 |
| 5 | LSETFLPNG | 0.000 |

TABLE XIV

V7B-HLA-A1101-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 9 | STLGYVALL | 0.015 |
| 7 | QQSTLGYVA | 0.012 |

TABLE XIV-continued

V7B-HLA-A1101-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 5 | AYQQSTLGY | 0.008 |
| 6 | YQQSTLGYV | 0.006 |
| 3 | NMAYQQSTL | 0.004 |
| 4 | MAYQQSTLG | 0.000 |
| 1 | FLNMAYQQS | 0.000 |
| 8 | QSTLGYVAL | 0.000 |
| 2 | LNMAYQQST | 0.000 |

TABLE XIV

V7C-HLA-A1101-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 167 | KLETIILSK | 2.400 |
| 159 | FLGSGTWMK | 0.800 |
| 175 | KLTQEQKSK | 0.600 |
| 21 | KCLGANILR | 0.360 |
| 128 | GPLWEFLLR | 0.360 |
| 131 | WEFLLRLLK | 0.240 |
| 13 | LASPAAAWK | 0.200 |
| 88 | GVVTEDDEA | 0.090 |
| 109 | ALKAANSWR | 0.080 |
| 69 | AQESGIRNK | 0.060 |
| 163 | GTWMKLETI | 0.060 |
| 37 | LPIEWQQDR | 0.060 |
| 126 | GVGPLWEFL | 0.060 |
| 38 | PIEWQQDRK | 0.040 |
| 31 | GLSEIVLPI | 0.024 |
| 173 | LSKLTQEQK | 0.020 |
| 9 | SVEVLASPA | 0.020 |
| 145 | GTLSLAFTS | 0.013 |

TABLE XIV-continued

V7C-HLA-A1101-
9mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 2 | SIVILDLSV | 0.012 |
| 67 | AEAQESGIR | 0.012 |
| 151 | FTSWSLGEF | 0.010 |
| 176 | LTQEQKSKH | 0.010 |
| 51 | STPPPPAMW | 0.010 |
| 59 | WTEEAGATA | 0.010 |
| 123 | HTNGVGPLW | 0.010 |
| 11 | EVLASPAAA | 0.009 |
| 82 | SQIPVVGVV | 0.009 |
| 108 | RALKAANSW | 0.009 |
| 57 | AMWTEEAGA | 0.008 |
| 165 | WMKLETIIL | 0.008 |
| 148 | SLAFTSWSL | 0.008 |
| 4 | VILDLSVEV | 0.006 |
| 103 | PESPDRALK | 0.006 |
| 42 | QQDRKIPPL | 0.006 |
| 24 | GANILRGGL | 0.006 |
| 35 | IVLPIEWQQ | 0.006 |
| 5 | ILDLSVEVL | 0.004 |
| 134 | LLRLLKSQA | 0.004 |
| 100 | IDPPESPDR | 0.004 |
| 141 | QAASGTLSL | 0.004 |
| 27 | ILRGGLSEI | 0.004 |
| 146 | TLSLAFTSW | 0.004 |
| 12 | VLASPAAAW | 0.004 |
| 17 | AAAWKCLGA | 0.004 |
| 157 | GEFLGSGTW | 0.004 |
| 3 | IVILDLSVE | 0.003 |
| 119 | PVLPHTNGV | 0.003 |
| 89 | VVTEDDEAQ | 0.002 |
| 66 | TAEAQESGI | 0.002 |
| 86 | VVGVVTEDD | 0.002 |
| 142 | AASGTLSLA | 0.002 |
| 112 | AANSWRNPV | 0.002 |

TABLE XIV-continued

V7C-HLA-A1101-
9mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 181 | KSKHCMFSL | 0.002 |
| 136 | RLLKSQAAS | 0.002 |
| 179 | EQKSKHCMF | 0.002 |
| 33 | SEIVLPIEW | 0.002 |
| 129 | PLWEFLLRL | 0.002 |
| 170 | TIILSKLTQ | 0.001 |
| 73 | GIRNKSSSS | 0.001 |
| 29 | RGGLSEIVL | 0.001 |
| 46 | KIPPLSTPP | 0.001 |
| 41 | WQQDRKIPP | 0.001 |
| 26 | NILRGGLSE | 0.001 |
| 105 | SPDRALKAA | 0.001 |
| 65 | ATAEAQESG | 0.001 |
| 15 | SPAAAWKCL | 0.001 |
| 90 | VTEDDEAQD | 0.001 |
| 158 | EFLGSGTWM | 0.001 |
| 10 | VEVLASPAA | 0.001 |
| 22 | CLGANILRG | 0.001 |
| 185 | CMFSLISGS | 0.001 |
| 184 | HCMFSLISG | 0.001 |
| 127 | VGPLWEFLL | 0.001 |
| 139 | KSQAASGTL | 0.001 |
| 125 | NGVGPLWEF | 0.001 |
| 64 | GATAEAQES | 0.001 |
| 140 | SQAASGTLS | 0.001 |
| 171 | IILSKLTQE | 0.001 |
| 96 | AQDSIDPPE | 0.001 |
| 168 | LETIILSKL | 0.001 |
| 178 | QEQKSKHCM | 0.001 |
| 101 | DPPESPDRA | 0.001 |
| 164 | TWMKLETII | 0.000 |
| 49 | PLSTPPPPA | 0.000 |
| 18 | AAWKCLGAN | 0.000 |

TABLE XIV-continued

V7C-HLA-A1101-
9mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 143 | ASGTLSLAF | 0.000 |
| 150 | AFTSWSLGE | 0.000 |
| 36 | VLPIEWQQD | 0.000 |
| 83 | QIPVVGVVT | 0.000 |
| 160 | LGSGTWMKL | 0.000 |
| 52 | TPPPPAMWT | 0.000 |
| 172 | ILSKLTQEQ | 0.000 |
| 115 | SWRNPVLPH | 0.000 |
| 99 | SIDPPESPD | 0.000 |
| 149 | LAFTSWSLG | 0.000 |
| 113 | ANSWRNPVL | 0.000 |
| 155 | SLGEFLGSG | 0.000 |
| 137 | LLKSQAASG | 0.000 |
| 120 | VLPHTNGVG | 0.000 |
| 78 | SSSSSQIPV | 0.000 |

TABLE XV

V1-HLA-A1101-
10mers-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 34 | GVIGSGDFAK | 27.000 |
| 55 | HVVIGSRNPK | 3.000 |
| 76 | VTHHEDALTK | 2.000 |
| 135 | SLFPDSLIVK | 1.600 |
| 21 | GINGIKDARK | 1.200 |
| 294 | WLETWLQCRK | 0.400 |
| 278 | AAYQLYYGTK | 0.400 |
| 150 | SAWALQLGPK | 0.400 |
| 17 | CLPNGINGIK | 0.400 |
| 281 | QLYYGTKYRR | 0.320 |

TABLE XV-continued

V1-HLA-A1101-
10mers-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 442 | VILDLLQLCR | 0.240 |
| 224 | TFFFLYSFVR | 0.240 |
| 407 | TFHVLIYGWK | 0.200 |
| 154 | LQLGPKDASR | 0.180 |
| 318 | AYSLCLPMRR | 0.160 |
| 204 | LPLRLFTLWR | 0.120 |
| 112 | ILIDVSNNMR | 0.120 |
| 280 | YQLYYGTKYR | 0.090 |
| 257 | KTLPIVAITL | 0.090 |
| 303 | KQLGLLSFFF | 0.081 |
| 166 | YICSNNIQAR | 0.080 |
| 269 | LVYLAGLLAA | 0.080 |
| 317 | VAYSLCLPMR | 0.080 |
| 240 | ARNQQSDFYK | 0.060 |
| 321 | LCLPMRRSER | 0.060 |
| 147 | NVVSAWALQL | 0.060 |
| 183 | RQLNFIPIDL | 0.054 |
| 364 | GIMSLGLLSL | 0.048 |
| 406 | STFHVLIYGW | 0.040 |
| 254 | IVNKTLPIVA | 0.040 |
| 314 | MVHVAYSLCL | 0.040 |
| 316 | HVAYSLCLPM | 0.040 |
| 356 | RIEMYISFGI | 0.036 |
| 425 | RFYTPPNFVL | 0.036 |
| 102 | WDLRHLLVGK | 0.030 |
| 248 | YKIPIEIVNK | 0.030 |
| 56 | VVIGSRNPKF | 0.030 |
| 285 | GTKYRRFPPW | 0.030 |
| 216 | VVVAISLATF | 0.030 |
| 83 | LTKTNIIFVA | 0.030 |
| 85 | KTNIIFVAIH | 0.030 |
| 396 | STLGYVALLI | 0.030 |
| 432 | FVLALVLPSI | 0.030 |
| 264 | ITLLSLVYLA | 0.030 |

TABLE XV-continued

V1-HLA-A1101-
10mers-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 163 | RQVYICSNNI | 0.027 |
| 416 | KRAFEEEYYR | 0.024 |
| 86 | TNIIFVAIHR | 0.024 |
| 39 | GDFAKSLTIR | 0.024 |
| 417 | RAFEEEYYRF | 0.024 |
| 207 | RLFTLWRGPV | 0.024 |
| 217 | VVAISLATFF | 0.020 |
| 223 | ATFFFLYSFV | 0.020 |
| 400 | YVALLISTFH | 0.020 |
| 261 | IVAITLLSLV | 0.020 |
| 32 | TVGVIGSGDF | 0.020 |
| 142 | IVKGFNVVSA | 0.020 |
| 231 | FVRDVIHPYA | 0.020 |
| 73 | VVDVTHHEDA | 0.020 |
| 340 | QVHANIENSW | 0.020 |
| 427 | YTPPNFVLAL | 0.020 |
| 339 | GYVALLISTF | 0.018 |
| 111 | KILIDVSNNM | 0.018 |
| 274 | GLLAAAYQLY | 0.018 |
| 48 | RLIRCGYHVV | 0.018 |
| 306 | GLLSFFFAMV | 0.018 |
| 100 | SLWDLRHLLV | 0.016 |
| 45 | LTIRLIRCGY | 0.015 |
| 209 | FTLWRGPVVV | 0.015 |
| 409 | HVLIYGWKRA | 0.015 |
| 408 | FHVLIYGWKR | 0.012 |
| 243 | QQSDFYKIPI | 0.012 |
| 440 | SIVILDLLQL | 0.012 |
| 24 | GIKDARKVTV | 0.012 |
| 304 | QLGLLSFFFA | 0.012 |
| 145 | GFNVVSAWAL | 0.012 |
| 359 | MYISFGIMSL | 0.012 |
| 172 | IQARQQVIEL | 0.012 |

TABLE XV-continued

V1-HLA-A1101-
10mers-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 121 | RINQYPESNA | 0.012 |
| 123 | NQYPESNAEY | 0.012 |
| 165 | VYICSNNIQA | 0.012 |
| 107 | LLVGKILIDV | 0.012 |
| 219 | AISLATFFFL | 0.012 |
| 268 | SLVYLAGLLA | 0.012 |
| 376 | VTSIPSVSNA | 0.010 |
| 2 | ESISMMGSPK | 0.009 |
| 401 | VALLISTFHV | 0.009 |
| 214 | GPVVVAISLA | 0.009 |
| 218 | VAISLATFFF | 0.009 |
| 384 | NALNWREFSF | 0.009 |
| 367 | SLGLLSLLAV | 0.008 |
| 307 | LLSFFFAMVH | 0.008 |
| 437 | VLPSIVILDL | 0.008 |
| 227 | FLYSFVRDVI | 0.008 |
| 42 | AKSLTIRLIR | 0.008 |
| 113 | LIDVSNNMRI | 0.008 |
| 210 | TLWRGPVVVA | 0.008 |
| 178 | VIELARQLNF | 0.008 |
| 298 | WLQCRKQLGL | 0.008 |
| 404 | LISTFHVLIY | 0.008 |
| 82 | ALTKTNIIFV | 0.008 |

TABLE XV

2V-HLA-A1101-
10mers-98P4B6
Each peptide is a portion of
SEQ ID NO: 5; each start
position is specified, the
length of peptide is 10 amino
acids, and the end position
for each peptide is the start
position plus nine.

| Start | Subsequence | Score |
|---|---|---|
| 16 | GFTPFSCLSL | 0.012 |
| 22 | CLSLPSSWDY | 0.008 |

TABLE XV-continued

2V-HLA-A1101-
10mers-98P4B6
Each peptide is a portion of
SEQ ID NO: 5; each start
position is specified, the
length of peptide is 10 amino
acids, and the end position
for each peptide is the start
position plus nine.

| Start | Subsequence | Score |
|---|---|---|
| 23 | LSLPSSWDYR | 0.006 |
| 32 | RCPPPCPADF | 0.006 |
| 8 | ALSLSLSSGF | 0.004 |
| 33 | CPPPCPADFF | 0.002 |
| 6 | LQALSLSLSS | 0.001 |
| 2 | GSPGLQALSL | 0.001 |
| 5 | GLQALSLSLS | 0.001 |
| 10 | SLSLSSGFTP | 0.001 |
| 30 | DYRCPPPCPA | 0.001 |
| 17 | FTPFSCLSLP | 0.001 |
| 18 | TPFSCLSLPS | 0.001 |
| 24 | SLPSSWDYRC | 0.001 |
| 35 | PPCPADFFLY | 0.001 |
| 34 | PPPCPADFFL | 0.001 |
| 36 | PCPADFFLYF | 0.000 |
| 12 | SLSSGFTPFS | 0.000 |
| 11 | LSLSSGFTPF | 0.000 |
| 21 | SCLSLPSSWD | 0.000 |
| 7 | QALSLSLSSG | 0.000 |
| 3 | SPGLQALSLS | 0.000 |
| 20 | FSCLSLPSSW | 0.000 |
| 14 | SSGFTPFSCL | 0.000 |
| 4 | PGLQALSLSL | 0.000 |
| 13 | LSSGFTPFSC | 0.000 |
| 29 | WDYRCPPPCP | 0.000 |
| 27 | SSWDYRCPPP | 0.000 |
| 15 | SGFTPFSCLS | 0.000 |
| 9 | LSLSLSSGFT | 0.000 |
| 31 | YRCPPPCPAD | 0.000 |
| 19 | PFSCLSLPSS | 0.000 |
| 25 | LPSSWDYRCP | 0.000 |
| 28 | SWDYRCPPPC | 0.000 |

TABLE XV-continued

2V-HLA-A1101-
10mers-98P4B6
Each peptide is a portion of
SEQ ID NO: 5; each start
position is specified, the
length of peptide is 10 amino
acids, and the end position
for each peptide is the start
position plus nine.

| Start | Subsequence | Score |
|---|---|---|
| 1 | SGSPGLQALS | 0.000 |
| 26 | PSSWDYRCPP | 0.000 |

TABLE XV

V5A-HLA-A1101-
10-mers-98P4B6
Each peptide is a portion of
SEQ ID NO: 11; each start
position is specified, the
length of peptide is 10 amino
acids, and the end position
for each peptide is the start
position plus nine.

| Start | Subsequence | Score |
|---|---|---|
| 3 | LPLRLFTFWR | 0.180 |
| 6 | RLFTFWRGPV | 0.024 |
| 8 | FTFWRGPVVV | 0.020 |
| 9 | TFWRGPVVVA | 0.004 |
| 2 | NLPLRLFTFW | 0.004 |
| 7 | LFTFWRGPVV | 0.002 |
| 1 | ENLPLRLFTF | 0.001 |
| 10 | FWRGPVVVAI | 0.000 |
| 4 | PLRLFTFWRG | 0.000 |
| 5 | LRLFTFWRGP | 0.000 |

TABLE XV

V5B-HLA-A1101-
10mers-98P4B6
Each peptide is a portion of
SEQ ID NO: 11; each start
position is specified, the
length of peptide is 10 amino
acids, and the end position
for each peptide is the start
position plus nine.

| Start | Subsequence | Score |
|---|---|---|
| 18 | QTELELEFVF | 0.030 |
| 16 | DTQTELELEF | 0.006 |
| 17 | TQTELELEFV | 0.006 |
| 14 | FADTQTELEL | 0.004 |
| 20 | ELELEFVFLL | 0.004 |

TABLE XV-continued

V5B-HLA-A1101-10mers-98P4B6
Each peptide is a portion of SEQ ID NO: 11; each start position is specified, the length of peptide is 10 amino acids, and the end position for each peptide is the start position plus nine.

| Start | Subsequence | Score |
|---|---|---|
| 6  | SFIQIFCSFA | 0.003 |
| 22 | ELEFVFLLTL | 0.002 |
| 24 | EFVFLLTLLL | 0.002 |
| 7  | FIQIFCSFAD | 0.001 |
| 23 | LEFVFLLTLL | 0.001 |
| 8  | IQIFCSFADT | 0.001 |
| 19 | TELELEFVFL | 0.001 |
| 9  | QIFCSFADTQ | 0.001 |
| 3  | REFSFIQIFC | 0.001 |
| 1  | NWREFSFIQI | 0.000 |
| 12 | CSFADTQTEL | 0.000 |
| 5  | FSFIQIFCSF | 0.000 |
| 13 | SFADTQTELE | 0.000 |
| 2  | WREFSFIQIF | 0.000 |
| 11 | FCSFADTQTE | 0.000 |
| 10 | IFCSFADTQT | 0.000 |
| 4  | EFSFIQIFCS | 0.000 |
| 21 | LELEFVFLLT | 0.000 |
| 15 | ADTQTELELE | 0.000 |

TABLE XV

V6-HLA-A1101-10mers-98P4B6
Each peptide is a portion of SEQ ID NO: 13; each start position is specified, the length of peptide is 10 amino acids, and the end position for each peptide is the start position plus nine.

| Start | Subsequence | Score |
|---|---|---|
| 42 | GTIPHVSPER | 0.900 |
| 2  | VLPSIVILGK | 0.800 |
| 13 | ILFLPCISRK | 0.800 |
| 12 | IILFLPCISR | 0.240 |
| 15 | FLPCISRKLK | 0.200 |
| 16 | LPCISRKLKR | 0.080 |

TABLE XV-continued

V6-HLA-A1101-10mers-98P4B6
Each peptide is a portion of SEQ ID NO: 13; each start position is specified, the length of peptide is 10 amino acids, and the end position for each peptide is the start position plus nine.

| Start | Subsequence | Score |
|---|---|---|
| 6  | IVILGKIILF | 0.060 |
| 19 | ISRKLKRIKK | 0.040 |
| 18 | CISRKLKRIK | 0.040 |
| 23 | LKRIKKGWEK | 0.040 |
| 46 | HVSPERVTVM | 0.020 |
| 5  | SIVILGKIIL | 0.012 |
| 7  | VILGKIILFL | 0.012 |
| 1  | LVLPSIVILG | 0.006 |
| 35 | FLEEGIGGTI | 0.004 |
| 43 | TIPHVSPERV | 0.004 |
| 33 | SQFLEEGIGG | 0.002 |
| 3  | LPSIVILGKI | 0.002 |
| 11 | KIILFLPCIS | 0.002 |
| 39 | GIGGTIPHVS | 0.001 |
| 8  | ILGKIILFLP | 0.001 |
| 22 | KLKRIKKGWE | 0.001 |
| 10 | GKIILFLPCI | 0.001 |
| 25 | RIKKGWEKSQ | 0.001 |
| 27 | KKGWEKSQFL | 0.001 |
| 21 | RKLKRIKKGW | 0.000 |
| 28 | KGWEKSQFLE | 0.000 |
| 37 | EEGIGGTIPH | 0.000 |
| 14 | LFLPCISRKL | 0.000 |
| 34 | QFLEEGIGGT | 0.000 |
| 26 | IKKGWEKSQF | 0.000 |
| 17 | PCISRKLKRI | 0.000 |
| 29 | GWEKSQFLEE | 0.000 |
| 24 | KRIKKGWEKS | 0.000 |
| 38 | EGIGGTIPHV | 0.000 |
| 41 | GGTIPHVSPE | 0.000 |
| 32 | KSQFLEEGIG | 0.000 |
| 36 | LEEGIGGTIP | 0.000 |
| 31 | EKSQFLEEGI | 0.000 |

TABLE XV-continued

V6-HLA-A1101-10mers-98P4B6
Each peptide is a portion of SEQ ID NO: 13; each start position is specified, the length of peptide is 10 amino acids, and the end position for each peptide is the start position plus nine.

| Start | Subsequence | Score |
|---|---|---|
| 30 | WEKSQFLEEG | 0.000 |
| 9 | LGKIILFLPC | 0.000 |
| 45 | PHVSPERVTV | 0.000 |
| 44 | IPHVSPERVT | 0.000 |
| 40 | IGGTIPHVSP | 0.000 |
| 4 | PSIVILGKII | 0.000 |
| 20 | SRKLKRIKKG | 0.000 |

TABLE XV

V7A-HLA-A1101-10mers-98P4B6
Each peptide is a portion of SEQ ID NO: 15; each start position is specified, the length of peptide is 10 amino acids, and the end position for each peptide is the start position plus nine.

| Start | Subsequence | Score |
|---|---|---|
| 10 | FLPNGINGIK | 0.400 |
| 9 | TFLPNGINGI | 0.003 |
| 2 | SPKSLSETFL | 0.002 |
| 8 | ETFLPNGING | 0.001 |
| 1 | GSPKSLSETF | 0.001 |
| 5 | SLSETFLPNG | 0.000 |
| 6 | LSETFLPNGI | 0.000 |
| 4 | KSLSETFLPN | 0.000 |
| 7 | SETFLPNGIN | 0.000 |
| 3 | PKSLSETFLP | 0.000 |

TABLE XV

V7B-A1101-10mers-98P4B6
Each peptide is a portion of SEQ ID NO: 15; each start position is specified, the length of peptide is 10 amino acids, and the end position for each peptide is the start position plus nine.

| Start | Subsequence | Score |
|---|---|---|
| 10 | STLGYVALLI | 0.030 |
| 7 | YQQSTLGYVA | 0.012 |
| 5 | MAYQQSTLGY | 0.008 |
| 8 | QQSTLGYVAL | 0.006 |
| 6 | AYQQSTLGYV | 0.004 |
| 3 | LNMAYQQSTL | 0.001 |
| 2 | FLNMAYQQST | 0.000 |
| 4 | NMAYQQSTLG | 0.000 |
| 1 | LFLNMAYQQS | 0.000 |
| 9 | QSTLGYVALL | 0.000 |

TABLE XV

V7C-A1101-10mers-98P4B6
Each peptide is a portion of SEQ ID NO: 15; each start position is specified, the length of peptide is 10 amino acids, and the end position for each peptide is the start position plus nine.

| Start | Subsequence | Score |
|---|---|---|
| 173 | ILSKLTQEQK | 0.400 |
| 13 | VLASPAAAWK | 0.400 |
| 38 | LPIEWQQDRK | 0.300 |
| 109 | RALKAANSWR | 0.180 |
| 127 | GVGPLWEFLL | 0.180 |
| 159 | EFLGSGTWMK | 0.180 |
| 100 | SIDPPESPDR | 0.080 |
| 37 | VLPIEWQQDR | 0.080 |
| 167 | MKLETIILSK | 0.060 |
| 164 | GTWMKLETII | 0.060 |
| 146 | GTLSLAFTSW | 0.045 |
| 131 | LWEFLLRLLK | 0.040 |
| 67 | TAEAQESGIR | 0.040 |
| 4 | IVILDLSVEV | 0.030 |
| 103 | PPESPDRALK | 0.020 |

TABLE XV-continued

V7C-A1101-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 10 | SVEVLASPAA | 0.020 |
| 129 | GPLWEFLLRL | 0.018 |
| 175 | SKLTQEQKSK | 0.015 |
| 176 | KLTQEQKSKH | 0.012 |
| 141 | SQAASGTLSL | 0.012 |
| 168 | KLETIILSKL | 0.012 |
| 66 | ATAEAQESGI | 0.010 |
| 152 | FTSWSLGEFL | 0.010 |
| 12 | EVLASPAAAW | 0.009 |
| 89 | GVVTEDDEAQ | 0.009 |
| 160 | FLGSGTWMKL | 0.008 |
| 21 | WKCLGANILR | 0.008 |
| 128 | VGPLWEFLLR | 0.008 |
| 5 | VILDLSVEVL | 0.006 |
| 112 | KAANSWRNPV | 0.006 |
| 134 | FLLRLLKSQA | 0.006 |
| 69 | EAQESGIRNK | 0.006 |
| 27 | NILRGGLSEI | 0.006 |
| 178 | TQEQKSKHCM | 0.006 |
| 42 | WQQDRKIPPL | 0.006 |
| 6 | ILDLSVEVLA | 0.004 |
| 135 | LLRLLKSQAA | 0.004 |
| 143 | AASGTLSLAF | 0.004 |
| 19 | AAWKCLGANI | 0.004 |
| 28 | ILRGGLSEIV | 0.004 |
| 158 | GEFLGSGTWM | 0.004 |
| 36 | IVLPIEWQQD | 0.003 |
| 119 | NPVLPHTNGV | 0.003 |
| 124 | HTNGVGPLWE | 0.002 |
| 113 | AANSWRNPVL | 0.002 |
| 122 | LPHTNGVGPL | 0.002 |
| 52 | STPPPPAMWT | 0.002 |
| 90 | VVTEDDEAQD | 0.002 |
| 142 | QAASGTLSLA | 0.002 |

TABLE XV-continued

V7C-A1101-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 87 | VVGVVTEDDE | 0.002 |
| 151 | AFTSWSLGEF | 0.002 |
| 31 | GGLSEIVLPI | 0.002 |
| 137 | RLLKSQAASG | 0.002 |
| 22 | KCLGANILRG | 0.002 |
| 74 | GIRNKSSSSS | 0.001 |
| 47 | KIPPLSTPPP | 0.001 |
| 32 | GLSEIVLPIE | 0.001 |
| 76 | RNKSSSSSQI | 0.001 |
| 78 | KSSSSSQIPV | 0.001 |
| 60 | WTEEAGATAE | 0.001 |
| 91 | VTEDDEAQDS | 0.001 |
| 83 | SQIPVVGVVT | 0.001 |
| 170 | ETIILSKLTQ | 0.001 |
| 11 | VEVLASPAAA | 0.001 |
| 165 | TWMKLETIIL | 0.001 |
| 125 | TNGVGPLWEF | 0.001 |
| 110 | ALKAANSWRN | 0.001 |
| 166 | WMKLETIILS | 0.001 |
| 115 | NSWRNPVLPH | 0.001 |
| 150 | LAFTSWSLGE | 0.001 |
| 58 | AMWTEEAGAT | 0.001 |
| 3 | SIVILDLSVE | 0.001 |
| 182 | KSKHCMFSLI | 0.001 |
| 171 | TIILSKLTQE | 0.001 |
| 70 | AQESGIRNKS | 0.001 |
| 181 | QKSKHCMFSL | 0.001 |
| 172 | IILSKLTQEQ | 0.001 |
| 148 | LSLAFTSWSL | 0.001 |
| 65 | GATAEAQESG | 0.001 |
| 25 | GANILRGGLS | 0.001 |
| 97 | AQDSIDPPES | 0.001 |
| 43 | QQDRKIPPLS | 0.001 |

TABLE XV-continued

V7C-A1101-10mers-98P4B6

Each peptide is a portion of SEQ ID NO: 15; each start position is specified, the length of peptide is 10 amino acids, and the end position for each peptide is the start position plus nine.

| Start | Subsequence | Score |
|---|---|---|
| 92 | TEDDEAQDSI | 0.001 |
| 61 | TEEAGATAEA | 0.001 |
| 179 | QEQKSKHCMF | 0.001 |
| 177 | LTQEQKSKHC | 0.001 |
| 147 | TLSLAFTSWS | 0.000 |
| 121 | VLPHTNGVGP | 0.000 |
| 17 | PAAAWKCLGA | 0.000 |
| 138 | LLKSQAASGT | 0.000 |
| 29 | LRGGLSEIVL | 0.000 |
| 53 | TPPPPAMWTE | 0.000 |
| 14 | LASPAAAWKC | 0.000 |
| 84 | QIPVVGVVTE | 0.000 |
| 50 | PLSTPPPPAM | 0.000 |
| 185 | HCMFSLISGS | 0.000 |
| 57 | PAMWTEEAGA | 0.000 |
| 149 | SLAFTSWSLG | 0.000 |
| 33 | LSEIVLPIEW | 0.000 |
| 156 | SLGEFLGSGT | 0.000 |

TABLE XVI

V1-HLA-A24-9mers-98P4B6

Each peptide is a portion of SEQ ID NO: 3; each start position is specified, the length of peptide is 9 amino acids, and the end position for each peptide is the start position plus eight.

| Start | Subsequence | Score |
|---|---|---|
| 287 | KYRRFPPWL | 400.000 |
| 426 | FYTPPNFVL | 240.000 |
| 337 | AYQQVHANI | 105.000 |
| 283 | YYGTKYRRF | 100.000 |
| 228 | LYSFVRDVI | 70.000 |
| 390 | EFSFIQSTL | 28.000 |
| 362 | SFGIMSLGL | 20.000 |

TABLE XVI-continued

V1-HLA-A24-9mers-98P4B6

Each peptide is a portion of SEQ ID NO: 3; each start position is specified, the length of peptide is 9 amino acids, and the end position for each peptide is the start position plus eight.

| Start | Subsequence | Score |
|---|---|---|
| 418 | AFEEEYYRF | 18.000 |
| 330 | RYLFLNMAY | 18.000 |
| 378 | SIPSVSNAL | 10.080 |
| 124 | QYPESNAEY | 9.900 |
| 399 | GYVALLIST | 9.000 |
| 177 | QVIELARQL | 8.640 |
| 184 | QLNFIPIDL | 8.400 |
| 258 | TLPIVAITL | 8.400 |
| 313 | AMVHVAYSL | 8.400 |
| 214 | GPVVVAISL | 8.400 |
| 246 | DFYKIPIEI | 7.700 |
| 270 | VYLAGLLAA | 7.500 |
| 359 | MYISFGIMS | 7.500 |
| 268 | SLVYLAGLL | 7.200 |
| 291 | FPPWLETWL | 7.200 |
| 366 | MSLGLLSLL | 7.200 |
| 220 | ISLATFFFL | 7.200 |
| 403 | LLISTFHVL | 7.200 |
| 303 | KQLGLLSFF | 7.200 |
| 436 | LVLPSIVIL | 7.200 |
| 200 | EIENLPLRL | 7.200 |
| 61 | RNPKFASEF | 6.600 |
| 428 | TPPNFVLAL | 6.000 |
| 274 | GLLAAAYQL | 6.000 |
| 125 | YPESNAEYL | 6.000 |
| 363 | FGIMSLGLL | 6.000 |
| 264 | ITLLSLVYL | 6.000 |
| 396 | STLGYVALL | 6.000 |
| 297 | TWLQCRKQL | 6.000 |
| 259 | LPIVAITLL | 6.000 |
| 5 | SMMGSPKSL | 6.000 |
| 203 | NLPLRLFTL | 6.000 |
| 441 | IVILDLLQL | 6.000 |
| 187 | FIPIDLGSL | 6.000 |

TABLE XVI-continued

V1-HLA-A24-9mers-98P4B6
Each peptide is a portion of SEQ ID NO: 3; each start position is specified, the length of peptide is 9 amino acids, and the end position for each peptide is the start position plus eight.

| Start | Subsequence | Score |
|---|---|---|
| 146 | FNVVSAWAL | 6.000 |
| 267 | LSLVYLAGL | 6.000 |
| 99 | TSLWDLRHL | 6.000 |
| 100 | SLWDLRHLL | 5.760 |
| 438 | LPSIVILDL | 5.600 |
| 85 | KTNIIFVAI | 5.040 |
| 247 | FYKIPIEIV | 5.000 |
| 423 | YYRFYTPPN | 5.000 |
| 128 | SNAEYLASL | 4.800 |
| 41 | FAKSLTIRL | 4.800 |
| 37 | GSGDFAKSL | 4.800 |
| 173 | QARQQVIEL | 4.400 |
| 300 | QCRKQLGLL | 4.000 |
| 75 | DVTHHEDAL | 4.000 |
| 395 | QSTLGYVAL | 4.000 |
| 299 | LQCRKQLGL | 4.000 |
| 133 | LASLFPDSL | 4.000 |
| 365 | IMSLGLLSL | 4.000 |
| 148 | VVSAWALQL | 4.000 |
| 360 | YISFGIMSL | 4.000 |
| 261 | IVAITLLSL | 4.000 |
| 196 | SSAREIENL | 4.000 |
| 129 | NAEYLASLF | 3.600 |
| 218 | VAISLATFF | 3.600 |
| 385 | ALNWREFSF | 3.000 |
| 33 | VGVIGSGDF | 3.000 |
| 400 | YVALLISTF | 2.400 |
| 304 | QLGLLSFFF | 2.400 |
| 383 | SNALNWREF | 2.200 |
| 57 | VIGSRNPKF | 2.200 |
| 223 | ATFFFLYSF | 2.000 |
| 411 | LIYGWKRAF | 2.000 |
| 219 | AISLATFFF | 2.000 |

TABLE XVI-continued

V1-HLA-A24-9mers-98P4B6
Each peptide is a portion of SEQ ID NO: 3; each start position is specified, the length of peptide is 9 amino acids, and the end position for each peptide is the start position plus eight.

| Start | Subsequence | Score |
|---|---|---|
| 62 | NPKFASEFF | 2.000 |
| 82 | ALTKTNIIF | 2.000 |
| 239 | YARNQQSDF | 2.000 |
| 217 | VVAISLATF | 2.000 |
| 242 | NQQSDFYKI | 1.980 |
| 81 | DALTKTNII | 1.800 |
| 17 | CLPNGINGI | 1.800 |
| 349 | WNEEEVWRI | 1.800 |
| 171 | NIQARQQVI | 1.800 |
| 290 | RFPPWLETW | 1.800 |
| 105 | RHLLVGKIL | 1.680 |
| 193 | GSLSSAREI | 1.650 |
| 112 | ILIDVSNNM | 1.512 |
| 435 | ALVLPSIVI | 1.500 |
| 106 | HLLVGKILI | 1.500 |
| 134 | ASLFPDSLI | 1.500 |
| 253 | EIVNKTLPI | 1.500 |
| 371 | LSLLAVTSI | 1.500 |
| 353 | EVWRIEMYI | 1.400 |
| 397 | TLGYVALLI | 1.400 |
| 433 | VLALVLPSI | 1.400 |
| 186 | NFIPIDLGS | 1.260 |
| 164 | QVYICSNNI | 1.200 |
| 180 | ELARQLNFI | 1.200 |
| 425 | RFYTPPNFV | 1.200 |
| 386 | LNWREFSFI | 1.200 |

TABLE XVI

V2-HLA-A24-
9mers-98P4B6
Each peptide is a portion of
SEQ ID NO: 5; each start
position is specified, the
length of peptide is 9 amino
acids, and the end position
for each peptide is the start
position plus eight.

| Start | Subsequence | Score |
|---|---|---|
| 5 | GLQALSLSL | 7.200 |
| 17 | FTPFSCLSL | 6.000 |
| 1 | SGSPGLQAL | 5.760 |
| 15 | SGFTPFSCL | 4.800 |
| 3 | SPGLQALSL | 4.000 |
| 33 | CPPPCPADF | 3.600 |
| 9 | LSLSLSSGF | 3.600 |
| 37 | CPADFFLYF | 2.880 |
| 12 | SLSSGFTPF | 2.400 |
| 16 | GFTPFSCLS | 0.600 |
| 30 | DYRCPPPCP | 0.500 |
| 35 | PPCPADFFL | 0.480 |
| 34 | PPPCPADFF | 0.300 |
| 23 | LSLPSSWDY | 0.180 |
| 2 | GSPGLQALS | 0.180 |
| 21 | SCLSLPSSW | 0.180 |
| 7 | QALSLSLSS | 0.180 |
| 14 | SSGFTPFSC | 0.100 |
| 10 | SLSLSSGFT | 0.100 |
| 6 | LQALSLSLS | 0.100 |
| 25 | LPSSWDYRC | 0.100 |
| 13 | LSSGFTPFS | 0.100 |
| 20 | FSCLSLPSS | 0.100 |
| 19 | PFSCLSLPS | 0.060 |
| 32 | RCPPPCPAD | 0.036 |
| 36 | PCPADFFLY | 0.018 |
| 24 | SLPSSWDYR | 0.015 |
| 4 | PGLQALSLS | 0.015 |
| 11 | LSLSSGFTP | 0.015 |
| 27 | SSWDYRCPP | 0.012 |
| 31 | YRCPPPCPA | 0.012 |
| 18 | TPFSCLSLP | 0.010 |
| 29 | WDYRCPPPC | 0.010 |
| 8 | ALSLSLSSG | 0.010 |

TABLE XVI-continued

V2-HLA-A24-
9mers-98P4B6
Each peptide is a portion of
SEQ ID NO: 5; each start
position is specified, the
length of peptide is 9 amino
acids, and the end position
for each peptide is the start
position plus eight.

| Start | Subsequence | Score |
|---|---|---|
| 28 | SWDYRCPPP | 0.010 |
| 22 | CLSLPSSWD | 0.010 |
| 26 | PSSWDYRCP | 0.001 |

TABLE XVI

V5A-HLA-A24-
9mers-98P4B6
Each peptide is a portion of
SEQ ID NO: 11; each start
position is specified, the
length of peptide is 9 amino
acids, and the end position
for each peptide is the start
position plus eight.

| Start | Subsequence | Score |
|---|---|---|
| 1 | NLPLRLFTF | 3.000 |
| 8 | TFWRGPVVV | 0.500 |
| 6 | LFTFWRGPV | 0.500 |
| 2 | LPLRLFTFW | 0.216 |
| 7 | FTFWRGPVV | 0.100 |
| 9 | FWRGPVVVA | 0.100 |
| 5 | RLFTFWRGP | 0.020 |
| 4 | LRLFTFWRG | 0.002 |
| 3 | PLRLFTFWR | 0.001 |

TABLE XVI

V5B-HLA-A24-
9mers-98P4B6
Each peptide is a portion of
SEQ ID NO: 11; each start
position is specified, the
length of peptide is 9 amino
acids, and the end position
for each peptide is the start
position plus eight.

| Start | Subsequence | Score |
|---|---|---|
| 23 | EFVFLLTLL | 36.000 |
| 12 | SFADTQTEL | 26.400 |
| 5 | SFIQIFCSF | 25.200 |
| 19 | ELELEFVFL | 7.200 |
| 24 | FVFLLTLLL | 4.800 |

TABLE XVI-continued

V5B-HLA-A24-
9mers-98P4B6
Each peptide is a portion of
SEQ ID NO: 11; each start
position is specified, the
length of peptide is 9 amino
acids, and the end position
for each peptide is the start
position plus eight.

| Start | Subsequence | Score |
|---|---|---|
| 16 | TQTELELEF | 3.168 |
| 20 | LELEFVFLL | 0.720 |
| 3 | EFSFIQIFC | 0.700 |
| 2 | REFSFIQIF | 0.480 |
| 14 | ADTQTELEL | 0.440 |
| 18 | TELELEFVF | 0.432 |
| 22 | LEFVFLLTL | 0.400 |
| 21 | ELEFVFLLT | 0.252 |
| 1 | WREFSFIQI | 0.180 |
| 6 | FIQIFCSFA | 0.150 |
| 17 | QTELELEFV | 0.150 |
| 8 | QIFCSFADT | 0.120 |
| 10 | FCSFADTQT | 0.100 |
| 4 | FSFIQIFCS | 0.100 |
| 9 | IFCSFADTQ | 0.050 |
| 7 | IQIFCSFAD | 0.015 |
| 15 | DTQTELELE | 0.015 |
| 11 | CSFADTQTE | 0.012 |
| 13 | FADTQTELE | 0.010 |

TABLE XVI

V6-HLA-A24-
9mers-98P4B6
Each peptide is a portion of
SEQ ID NO: 13; each start
position is specified, the
length of peptide is 9 amino
acids, and the end position
for each peptide is the start
position plus eight.

| Start | Subsequence | Score |
|---|---|---|
| 27 | KGWEKSQFL | 11.520 |
| 14 | FLPCISRKL | 9.240 |
| 5 | IVILGKIIL | 6.000 |
| 7 | ILGKIILFL | 5.600 |
| 31 | KSQFLEEGI | 3.600 |
| 10 | KIILFLPCI | 3.000 |

TABLE XVI-continued

V6-HLA-A24-
9mers-98P4B6
Each peptide is a portion of
SEQ ID NO: 13; each start
position is specified, the
length of peptide is 9 amino
acids, and the end position
for each peptide is the start
position plus eight.

| Start | Subsequence | Score |
|---|---|---|
| 6 | VILGKIILF | 3.000 |
| 4 | SIVILGKII | 1.800 |
| 17 | CISRKLKRI | 1.000 |
| 46 | VSPERVTVM | 0.900 |
| 26 | KKGWEKSQF | 0.400 |
| 21 | KLKRIKKGW | 0.280 |
| 3 | PSIVILGKI | 0.231 |
| 24 | RIKKGWEKS | 0.220 |
| 35 | LEEGIGGTI | 0.210 |
| 34 | FLEEGIGGT | 0.180 |
| 11 | IILFLPCIS | 0.180 |
| 39 | IGGTIPHVS | 0.140 |
| 45 | HVSPERVTV | 0.120 |
| 38 | GIGGTIPHV | 0.100 |
| 43 | IPHVSPERV | 0.100 |
| 33 | QFLEEGIGG | 0.090 |
| 13 | LFLPCISRK | 0.090 |
| 42 | TIPHVSPER | 0.023 |
| 9 | GKIILFLPC | 0.022 |
| 1 | VLPSIVILG | 0.021 |
| 41 | GTIPHVSPE | 0.018 |
| 28 | GWEKSQFLE | 0.015 |
| 37 | EGIGGTIPH | 0.015 |
| 2 | LPSIVILGK | 0.014 |
| 8 | LGKIILFLP | 0.014 |
| 18 | ISRKLKRIK | 0.012 |
| 32 | SQFLEEGIG | 0.010 |
| 40 | GGTIPHVSP | 0.010 |
| 15 | LPCISRKLK | 0.010 |
| 12 | ILFLPCISR | 0.010 |
| 23 | KRIKKGWEK | 0.003 |
| 20 | RKLKRIKKG | 0.003 |
| 16 | PCISRKLKR | 0.002 |

TABLE XVI-continued

V6-HLA-A24-
9mers-98P4B6
Each peptide is a portion of
SEQ ID NO: 13; each start
position is specified, the
length of peptide is 9 amino
acids, and the end position
for each peptide is the start
position plus eight.

| Start | Subsequence | Score |
|---|---|---|
| 44 | PHVSPERVT | 0.002 |
| 29 | WEKSQFLEE | 0.001 |
| 19 | SRKLKRIKK | 0.001 |
| 30 | EKSQFLEEG | 0.001 |
| 22 | LKRIKKGWE | 0.001 |
| 25 | IKKGWEKSQ | 0.001 |
| 36 | EEGIGGTIP | 0.001 |

TABLE XVI

V7A-HLA-A24-
9mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 1 | SPKSLSETF | 2.400 |
| 9 | FLPNGINGI | 1.800 |
| 4 | SLSETFLPN | 0.144 |
| 6 | SETFLPNGI | 0.144 |
| 7 | ETFLPNGIN | 0.100 |
| 8 | TFLPNGING | 0.090 |
| 2 | PKSLSETFL | 0.040 |
| 3 | KSLSETFLP | 0.030 |
| 5 | LSETFLPNG | 0.015 |

TABLE XVI

V7B-HLA-A24-
9mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 5 | AYQQSTLGY | 7.500 |
| 9 | STLGYVALL | 6.000 |

TABLE XVI-continued

V7B-HLA-A24-
9mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 8 | QSTLGYVAL | 4.000 |
| 3 | NMAYQQSTL | 4.000 |
| 1 | FLNMAYQQS | 0.180 |
| 2 | LNMAYQQST | 0.180 |
| 6 | YQQSTLGYV | 0.150 |
| 7 | QQSTLGYVA | 0.120 |
| 4 | MAYQQSTLG | 0.010 |

TABLE XVI

V7C-HLA-A24-
10mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 139 | KSQAASGTL | 12.000 |
| 29 | RGGLSEIVL | 8.000 |
| 181 | KSKHCMFSL | 8.000 |
| 130 | LWEFLLRLL | 7.200 |
| 24 | GANILRGGL | 7.200 |
| 127 | VGPLWEFLL | 6.000 |
| 126 | GVGPLWEFL | 5.760 |
| 152 | TSWSLGEFL | 4.800 |
| 160 | LGSGTWMKL | 4.400 |
| 148 | SLAFTSWSL | 4.000 |
| 42 | QQDRKIPPL | 4.000 |
| 15 | SPAAAWKCL | 4.000 |
| 141 | QAASGTLSL | 4.000 |
| 5 | ILDLSVEVL | 4.000 |
| 165 | WMKLETIIL | 4.000 |
| 113 | ANSWRNPVL | 4.000 |
| 158 | EFLGSGTWM | 3.750 |
| 125 | NGVGPLWEF | 3.300 |

TABLE XVI-continued

V7C-HLA-A24-
10mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 143 | ASGTLSLAF | 2.400 |
| 151 | FTSWSLGEF | 2.200 |
| 179 | EQKSKHCMF | 2.000 |
| 164 | TWMKLETII | 1.800 |
| 31 | GLSEIVLPI | 1.680 |
| 66 | TAEAQESGI | 1.500 |
| 19 | AWKCLGANI | 1.200 |
| 27 | ILRGGLSEI | 1.100 |
| 163 | GTWMKLETI | 1.000 |
| 132 | EFLLRLLKS | 0.825 |
| 168 | LETIILSKL | 0.616 |
| 102 | PPESPDRAL | 0.600 |
| 50 | LSTPPPPAM | 0.600 |
| 129 | PLWEFLLRL | 0.480 |
| 20 | WKCLGANIL | 0.480 |
| 108 | RALKAANSW | 0.360 |
| 117 | RNPVLPHTN | 0.360 |
| 136 | RLLKSQAAS | 0.300 |
| 82 | SQIPVVGVV | 0.252 |
| 4 | VILDLSVEV | 0.238 |
| 123 | HTNGVGPLW | 0.210 |
| 83 | QIPVVGVVT | 0.210 |
| 104 | ESPDRALKA | 0.198 |
| 51 | STPPPPAMW | 0.180 |
| 145 | GTLSLAFTS | 0.180 |
| 154 | WSLGEFLGS | 0.180 |
| 68 | EAQESGIRN | 0.180 |
| 9 | SVEVLASPA | 0.180 |
| 59 | WTEEAGATA | 0.180 |
| 156 | LGEFLGSGT | 0.180 |
| 52 | TPPPPAMWT | 0.180 |
| 112 | AANSWRNPV | 0.180 |
| 101 | DPPESPDRA | 0.180 |
| 2 | SIVILDLSV | 0.180 |

TABLE XVI-continued

V7C-HLA-A24-
10mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 169 | ETIILSKLT | 0.180 |
| 88 | GVVTEDDEA | 0.165 |
| 14 | ASPAAAWKC | 0.165 |
| 25 | ANILRGGLS | 0.150 |
| 72 | SGIRNKSSS | 0.150 |
| 11 | EVLASPAAA | 0.150 |
| 81 | SSQIPVVGV | 0.150 |
| 177 | TQEQKSKHC | 0.150 |
| 147 | LSLAFTSWS | 0.150 |
| 64 | GATAEAQES | 0.132 |
| 134 | LLRLLKSQA | 0.120 |
| 146 | TLSLAFTSW | 0.120 |
| 185 | CMFSLISGS | 0.120 |
| 182 | SKHCMFSLI | 0.120 |
| 58 | MWTEEAGAT | 0.120 |
| 92 | EDDEAQDSI | 0.120 |
| 39 | IEWQQDRKI | 0.110 |
| 162 | SGTWMKLET | 0.110 |
| 17 | AAAWKCLGA | 0.100 |
| 79 | SSSSQIPVV | 0.100 |
| 140 | SQAASGTLS | 0.100 |
| 76 | NKSSSSSQI | 0.100 |
| 142 | AASGTLSLA | 0.100 |
| 105 | SPDRALKAA | 0.100 |
| 57 | AMWTEEAGA | 0.100 |
| 144 | SGTLSLAFT | 0.100 |
| 18 | AAWKCLGAN | 0.100 |
| 7 | DLSVEVLAS | 0.100 |
| 78 | SSSSSQIPV | 0.100 |
| 12 | VLASPAAAW | 0.100 |
| 73 | GIRNKSSSS | 0.100 |
| 71 | ESGIRNKSS | 0.100 |
| 178 | QEQKSKHCM | 0.075 |

TABLE XVI-continued

V7C-HLA-A24-
10mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 150 | AFTSWSLGE | 0.050 |
| 46 | KIPPLSTPP | 0.043 |
| 167 | KLETIILSK | 0.042 |
| 122 | PHTNGVGPL | 0.040 |
| 21 | KCLGANILR | 0.030 |
| 116 | WRNPVLPHT | 0.025 |
| 35 | IVLPIEWQQ | 0.025 |
| 8 | LSVEVLASP | 0.025 |
| 77 | KSSSSSQIP | 0.024 |
| 119 | PVLPHTNGV | 0.022 |
| 37 | LPIEWQQDR | 0.022 |
| 1 | PSIVILDLS | 0.021 |
| 6 | LDLSVEVLA | 0.021 |
| 32 | LSEIVLPIE | 0.021 |
| 183 | KHCMFSLIS | 0.020 |

TABLE XVII

V1-HLA-A24-
10mers-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 124 | QYPESNAEYL | 360.000 |
| 359 | MYISFGIMSL | 300.000 |
| 399 | GYVALLISTF | 180.000 |
| 282 | LYYGTKYRRF | 100.000 |
| 423 | YYRFYTPPNF | 100.000 |
| 290 | RFPPWLETWL | 86.400 |
| 425 | RFYTPPNFVL | 40.000 |
| 186 | NFIPIDLGSL | 36.000 |
| 145 | GFNVVSAWAL | 30.000 |
| 40 | DFAKSLTIRL | 24.000 |

TABLE XVII-continued

V1-HLA-A24-
10mers-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 257 | KTLPIVAITL | 20.160 |
| 362 | SFGIMSLGLL | 20.000 |
| 213 | RGPVVVAISL | 16.800 |
| 183 | RQLNFIPIDL | 16.800 |
| 377 | TSIPSVSNAL | 12.096 |
| 131 | EYLASLFPDS | 10.800 |
| 250 | IPIEIVNKTL | 10.080 |
| 238 | PYARNQQSDF | 10.000 |
| 270 | VYLAGLLAAA | 9.000 |
| 437 | VLPSIVILDL | 8.400 |
| 312 | FAMVHVAYSL | 8.400 |
| 279 | AYQLYYGTKY | 8.250 |
| 165 | VYICSNNIQA | 7.500 |
| 176 | QQVIELARQL | 7.200 |
| 202 | ENLPLRLFTL | 7.200 |
| 99 | TSLWDLRHLL | 7.200 |
| 427 | YTPPNFVLAL | 7.200 |
| 303 | KQLGLLSFFF | 7.200 |
| 267 | LSLVYLAGLL | 7.200 |
| 426 | FYTPPNFVLA | 7.200 |
| 402 | ALLISTFHVL | 7.200 |
| 53 | GYHVVIGSRN | 7.000 |
| 247 | FYKIPIEIVN | 7.000 |
| 364 | GIMSLGLLSL | 6.000 |
| 127 | ESNAEYLASL | 6.000 |
| 61 | RNPKFASEFF | 6.000 |
| 298 | WLQCRKQLGL | 6.000 |
| 4 | ISMMGSPKSL | 6.000 |
| 273 | AGLLAAAYQL | 6.000 |
| 323 | LPMRRSERYL | 6.000 |
| 147 | NVVSAWALQL | 6.000 |
| 435 | ALVLPSIVIL | 6.000 |
| 440 | SIVILDLLQL | 6.000 |
| 258 | TLPIVAITLL | 6.000 |

TABLE XVII-continued

V1-HLA-A24-
10mers-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 438 | LPSIVILDLL | 5.600 |
| 422 | EYYRFYTPPN | 5.000 |
| 219 | AISLATFFFL | 4.800 |
| 417 | RAFEEEYYRF | 4.800 |
| 365 | IMSLGLLSLL | 4.800 |
| 197 | SAREIENLPL | 4.800 |
| 172 | IQARQQVIEL | 4.400 |
| 356 | RIEMYISFGI | 4.200 |
| 36 | IGSGDFAKSL | 4.000 |
| 98 | YTSLWDLRHL | 4.000 |
| 132 | YLASLFPDSL | 4.000 |
| 296 | ETWLQCRKQL | 4.000 |
| 266 | LLSLVYLAGL | 4.000 |
| 195 | LSSAREIENL | 4.000 |
| 314 | MVHVAYSLCL | 4.000 |
| 263 | AITLLSLVYL | 4.000 |
| 299 | LQCRKQLGLL | 4.000 |
| 92 | AIHREHYTSL | 4.000 |
| 361 | ISFGIMSLGL | 4.000 |
| 9 | SPKSLSETCL | 4.000 |
| 395 | QSTLGYVALL | 4.000 |
| 394 | IQSTLGYVAL | 4.000 |
| 241 | RNQQSDFYKI | 3.960 |
| 163 | RQVYICSNNI | 3.600 |
| 382 | VSNALNWREF | 3.300 |
| 56 | VVIGSRNPKF | 3.300 |
| 384 | NALNWREFSF | 3.000 |
| 410 | VLIYGWKRAF | 3.000 |
| 216 | VVVAISLATF | 3.000 |
| 178 | VIELARQLNF | 3.000 |
| 218 | VAISLATFFF | 3.000 |
| 200 | EIENLPLRLF | 3.000 |
| 81 | DALTKTNIIF | 3.000 |

TABLE XVII-continued

V1-HLA-A24-
10mers-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 128 | SNAEYLASLF | 2.880 |
| 137 | FPDSLIVKGF | 2.800 |
| 111 | KILIDVSNNM | 2.520 |
| 217 | VVAISLATFF | 2.400 |
| 16 | TCLPNGINGI | 2.160 |
| 327 | RSERYLFLNM | 2.160 |
| 13 | LSETCLPNGI | 2.160 |
| 396 | STLGYVALLI | 2.100 |
| 432 | FVLALVLPSI | 2.100 |
| 354 | VWRIEMYISF | 2.000 |
| 222 | LATFFFLYSF | 2.000 |
| 32 | TVGVIGSGDF | 2.000 |
| 385 | ALNWREFSFI | 1.800 |
| 170 | NNIQARQQVI | 1.800 |
| 348 | SWNEEEVWRI | 1.800 |
| 199 | REIENLPLRL | 1.728 |
| 403 | LLISTFHVLI | 1.500 |
| 330 | RYLFLNMAYQ | 1.500 |
| 434 | LALVLPSIVI | 1.500 |
| 211 | LWRGPVVVAI | 1.400 |
| 336 | MAYQQVHANI | 1.400 |
| 227 | FLYSFVRDVI | 1.400 |
| 103 | DLRHLLVGKI | 1.320 |

TABLE XVII

V2-HLA-A24-
10mers-98P4B6
Each peptide is a portion of
SEQ ID NO: 5; each start
position is specified, the
length of peptide is 10 amino
acids, and the end position
for each peptide is the start
position plus nine.

| Start | Subsequence | Score |
|---|---|---|
| 16 | GFTPFSCLSL | 24.000 |
| 32 | RCPPPCPADF | 7.200 |

TABLE XVII-continued

V2-HLA-A24-10mers-98P4B6
Each peptide is a portion of SEQ ID NO: 5; each start position is specified, the length of peptide is 10 amino acids, and the end position for each peptide is the start position plus nine.

| Start | Subsequence | Score |
|---|---|---|
| 2 | GSPGLQALSL | 6.000 |
| 30 | DYRCPPPCPA | 5.000 |
| 14 | SSGFTPFSCL | 4.800 |
| 11 | LSLSSGFTPF | 3.600 |
| 33 | CPPPCPADFF | 3.600 |
| 8 | ALSLSLSSGF | 2.400 |
| 4 | PGLQALSLSL | 0.720 |
| 34 | PPPCPADFFL | 0.600 |
| 36 | PCPADFFLYF | 0.360 |
| 9 | LSLSLSSGFT | 0.150 |
| 5 | GLQALSLSLS | 0.150 |
| 24 | SLPSSWDYRC | 0.150 |
| 1 | SGSPGLQALS | 0.144 |
| 6 | LQALSLSLSS | 0.120 |
| 20 | FSCLSLPSSW | 0.120 |
| 18 | TPFSCLSLPS | 0.120 |
| 15 | SGFTPFSCLS | 0.100 |
| 12 | SLSSGFTPFS | 0.100 |
| 28 | SWDYRCPPPC | 0.100 |
| 13 | LSSGFTPFSC | 0.100 |
| 3 | SPGLQALSLS | 0.100 |
| 22 | CLSLPSSWDY | 0.100 |
| 19 | PFSCLSLPSS | 0.050 |
| 23 | LSLPSSWDYR | 0.018 |
| 7 | QALSLSLSSG | 0.015 |
| 17 | FTPFSCLSLP | 0.015 |
| 21 | SCLSLPSSWD | 0.015 |
| 35 | PPCPADFFLY | 0.014 |
| 27 | SSWDYRCPPP | 0.012 |
| 25 | LPSSWDYRCP | 0.010 |
| 10 | SLSLSSGFTP | 0.010 |
| 31 | YRCPPPCPAD | 0.001 |
| 29 | WDYRCPPPCP | 0.001 |
| 26 | PSSWDYRCPP | 0.001 |

TABLE XVII

V5A-HLA-A24-10mers-98P4B6
Each peptide is a portion of SEQ ID NO: 11; each start position is specified, the length of peptide is 10 amino acids, and the end position for each peptide is the start position plus nine.

| Start | Subsequence | Score |
|---|---|---|
| 1 | ENLPLRLFTF | 3.600 |
| 10 | FWRGPVVVAI | 1.400 |
| 7 | LFTFWRGPVV | 0.500 |
| 9 | TFWRGPVVVA | 0.500 |
| 2 | NLPLRLFTFW | 0.216 |
| 6 | RLFTFWRGPV | 0.200 |
| 8 | FTFWRGPVVV | 0.100 |
| 3 | LPLRLFTFWR | 0.015 |
| 5 | LRLFTFWRGP | 0.002 |
| 4 | PLRLFTFWRG | 0.001 |

TABLE XVII

V5B-HLA-A24-10mers-98P4B6
Each peptide is a portion of SEQ ID NO: 11; each start position is specified, the length of peptide is 10 amino acids, and the end position for each peptide is the start position plus nine.

| Start | Subsequence | Score |
|---|---|---|
| 24 | EFVFLLTLLL | 36.000 |
| 22 | ELEFVFLLTL | 6.000 |
| 20 | ELELEFVFLL | 6.000 |
| 12 | CSFADTQTEL | 4.400 |
| 14 | FADTQTELEL | 4.400 |
| 16 | DTQTELELEF | 3.960 |
| 18 | QTELELEFVF | 3.600 |

TABLE XVII-continued

V5B-HLA-A24-10mers-98P4B6
Each peptide is a portion of SEQ ID NO: 11; each start position is specified, the length of peptide is 10 amino acids, and the end position for each peptide is the start position plus nine.

| Start | Subsequence | Score |
|---|---|---|
| 5 | FSFIQIFCSF | 3.360 |
| 1 | NWREFSFIQI | 1.440 |
| 19 | TELELEFVFL | 0.864 |
| 6 | SFIQIFCSFA | 0.750 |
| 4 | EFSFIQIFCS | 0.500 |
| 10 | IFCSFADTQT | 0.500 |
| 23 | LEFVFLLTLL | 0.480 |
| 2 | WREFSFIQIF | 0.360 |
| 8 | IQIFCSFADT | 0.180 |
| 17 | TQTELELEFV | 0.120 |
| 13 | SFADTQTELE | 0.060 |
| 21 | LELEFVFLLT | 0.030 |
| 3 | REFSFIQIFC | 0.028 |
| 7 | FIQIFCSFAD | 0.015 |
| 11 | FCSFADTQTE | 0.012 |
| 9 | QIFCSFADTQ | 0.010 |
| 15 | ADTQTELELE | 0.001 |

TABLE XVII

V6-HLA-A24-10mers-98P4B6
Each peptide is a portion of SEQ ID NO: 13; each start position is specified, the length of peptide is 10 amino acids, and the end position for each peptide is the start position plus nine.

| Start | Subsequence | Score |
|---|---|---|
| 14 | LFLPCISRKL | 55.440 |
| 7 | VILGKIILFL | 18.400 |
| 5 | SIVILGKIIL | 6.000 |
| 6 | IVILGKIILF | 3.000 |
| 35 | FLEEGIGGTI | 2.520 |
| 3 | LPSIVILGKI | 1.540 |
| 27 | KKGWEKSQFL | 0.960 |
| 34 | QFLEEGIGGT | 0.900 |

TABLE XVII-continued

V6-HLA-A24-10mers-98P4B6
Each peptide is a portion of SEQ ID NO: 13; each start position is specified, the length of peptide is 10 amino acids, and the end position for each peptide is the start position plus nine.

| Start | Subsequence | Score |
|---|---|---|
| 46 | HVSPERVTVM | 0.600 |
| 11 | KIILFLPCIS | 0.360 |
| 26 | IKKGWEKSQF | 0.200 |
| 4 | PSIVILGKII | 0.180 |
| 38 | EGIGGTIPHV | 0.150 |
| 17 | PCISRKLKRI | 0.150 |
| 43 | TIPHVSPERV | 0.150 |
| 10 | GKIILFLPCI | 0.150 |
| 9 | LGKIILFLPC | 0.144 |
| 39 | GIGGTIPHVS | 0.140 |
| 31 | EKSQFLEEGI | 0.120 |
| 44 | IPHVSPERVT | 0.100 |
| 21 | RKLKRIKKGW | 0.042 |
| 24 | KRIKKGWEKS | 0.033 |
| 32 | KSQFLEEGIG | 0.030 |
| 42 | GTIPHVSPER | 0.028 |
| 1 | LVLPSIVILG | 0.025 |
| 28 | KGWEKSQFLE | 0.024 |
| 2 | VLPSIVILGK | 0.021 |
| 25 | RIKKGWEKSQ | 0.020 |
| 22 | KLKRIKKGWE | 0.020 |
| 29 | GWEKSQFLEE | 0.020 |
| 12 | IILFLPCISR | 0.015 |
| 15 | FLPCISRKLK | 0.015 |
| 8 | ILGKIILFLP | 0.014 |
| 18 | CISRKLKRIK | 0.012 |
| 16 | LPCISRKLKR | 0.011 |
| 19 | ISRKLKRIKK | 0.011 |
| 33 | SQFLEEGIGG | 0.010 |
| 41 | GGTIPHVSPE | 0.010 |
| 40 | IGGTIPHVSP | 0.010 |
| 13 | ILFLPCISRK | 0.010 |
| 36 | LEEGIGGTIP | 0.002 |

TABLE XVII-continued

V6-HLA-A24-
10mers-98P4B6
Each peptide is a portion of
SEQ ID NO: 13; each start
position is specified, the
length of peptide is 10 amino
acids, and the end position
for each peptide is the start
position plus nine.

| Start | Subsequence | Score |
|---|---|---|
| 45 | PHVSPERVTV | 0.002 |
| 20 | SRKLKRIKKG | 0.001 |
| 30 | WEKSQFLEEG | 0.001 |
| 23 | LKRIKKGWEK | 0.001 |
| 37 | EEGIGGTIPH | 0.001 |

TABLE XVII

V7A-HLA-A24-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 9 | TFLPNGINGI | 10.800 |
| 2 | SPKSLSETFL | 4.000 |
| 1 | GSPKSLSETF | 3.600 |
| 6 | LSETFLPNGI | 2.160 |
| 4 | KSLSETFLPN | 0.360 |
| 10 | FLPNGINGIK | 0.021 |
| 5 | SLSETFLPNG | 0.012 |
| 7 | SETFLPNGIN | 0.010 |
| 8 | ETFLPNGING | 0.010 |
| 3 | PKSLSETFLP | 0.000 |

TABLE XVII

V7B-A24-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 6 | AYQQSTLGYV | 7.500 |
| 3 | LNMAYQQSTL | 6.000 |

TABLE XVII-continued

V7B-A24-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 8 | QQSTLGYVAL | 4.000 |
| 9 | QSTLGYVALL | 4.000 |
| 10 | STLGYVALLI | 2.100 |
| 1 | LFLNMAYQQS | 0.900 |
| 7 | YQQSTLGYVA | 0.180 |
| 2 | FLNMAYQQST | 0.180 |
| 5 | MAYQQSTLGY | 0.100 |
| 4 | NMAYQQSTLG | 0.010 |

TABLE XVII

V7C-HLA-A24-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 168 | KLETIILSKL | 18.480 |
| 151 | AFTSWSLGEF | 11.000 |
| 5 | VILDLSVEVL | 7.200 |
| 42 | WQQDRKIPPL | 7.200 |
| 126 | NGVGPLWEFL | 7.200 |
| 102 | DPPESPDRAL | 7.200 |
| 113 | AANSWRNPVL | 6.000 |
| 129 | GPLWEFLLRL | 6.000 |
| 148 | LSLAFTSWSL | 6.000 |
| 15 | ASPAAAWKCL | 6.000 |
| 165 | TWMKLETIIL | 6.000 |
| 24 | LGANILRGGL | 4.800 |
| 20 | AWKCLGANIL | 4.800 |
| 127 | GVGPLWEFLL | 4.800 |
| 152 | FTSWSLGEFL | 4.800 |
| 160 | FLGSGTWMKL | 4.400 |
| 122 | LPHTNGVGPL | 4.000 |

TABLE XVII-continued

V7C-HLA-A24-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 141 | SQAASGTLSL | 4.000 |
| 182 | KSKHCMFSLI | 2.400 |
| 143 | AASGTLSLAF | 2.400 |
| 125 | TNGVGPLWEF | 2.200 |
| 31 | GGLSEIVLPI | 2.100 |
| 76 | RNKSSSSSQI | 2.000 |
| 27 | NILRGGLSEI | 1.650 |
| 164 | GTWMKLETII | 1.200 |
| 19 | AAWKCLGANI | 1.200 |
| 66 | ATAEAQESGI | 1.200 |
| 163 | SGTWMKLETI | 1.000 |
| 178 | TQEQKSKHCM | 0.750 |
| 130 | PLWEFLLRLL | 0.576 |
| 29 | LRGGLSEIVL | 0.400 |
| 181 | QKSKHCMFSL | 0.400 |
| 139 | LKSQAASGTL | 0.400 |
| 179 | QEQKSKHCMF | 0.300 |
| 140 | KSQAASGTLS | 0.300 |
| 70 | AQESGIRNKS | 0.277 |
| 83 | SQIPVVGVVT | 0.252 |
| 112 | KAANSWRNPV | 0.240 |
| 91 | VTEDDEAQDS | 0.216 |
| 9 | LSVEVLASPA | 0.216 |
| 82 | SSQIPVVGVV | 0.210 |
| 78 | KSSSSSQIPV | 0.200 |
| 4 | IVILDLSVEV | 0.198 |
| 33 | LSEIVLPIEW | 0.198 |
| 119 | NPVLPHTNGV | 0.180 |
| 105 | ESPDRALKAA | 0.180 |
| 52 | STPPPPAMWT | 0.180 |
| 177 | LTQEQKSKHC | 0.180 |
| 134 | FLLRLLKSQA | 0.180 |
| 185 | HCMFSLISGS | 0.180 |
| 146 | GTLSLAFTSW | 0.180 |

TABLE XVII-continued

V7C-HLA-A24-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 39 | PIEWQQDRKI | 0.165 |
| 88 | VGVVTEDDEA | 0.165 |
| 10 | SVEVLASPAA | 0.150 |
| 73 | SGIRNKSSSS | 0.150 |
| 25 | GANILRGGLS | 0.150 |
| 157 | LGEFLGSGTW | 0.150 |
| 12 | EVLASPAAAW | 0.150 |
| 156 | SLGEFLGSGT | 0.144 |
| 1 | LPSIVILDLS | 0.140 |
| 6 | ILDLSVEVLA | 0.140 |
| 116 | SWRNPVLPHT | 0.140 |
| 43 | QQDRKIPPLS | 0.140 |
| 64 | AGATAEAQES | 0.132 |
| 14 | LASPAAAWKC | 0.132 |
| 174 | LSKLTQEQKS | 0.132 |
| 51 | LSTPPPPAMW | 0.120 |
| 92 | TEDDEAQDSI | 0.120 |
| 135 | LLRLLKSQAA | 0.120 |
| 106 | SPDRALKAAN | 0.120 |
| 59 | MWTEEAGATA | 0.120 |
| 28 | ILRGGLSEIV | 0.120 |
| 154 | SWSLGEFLGS | 0.120 |
| 145 | SGTLSLAFTS | 0.120 |
| 162 | GSGTWMKLET | 0.110 |
| 97 | AQDSIDPPES | 0.110 |
| 147 | TLSLAFTSWS | 0.100 |
| 180 | EQKSKHCMFS | 0.100 |
| 79 | SSSSSQIPVV | 0.100 |
| 142 | QAASGTLSLA | 0.100 |
| 18 | AAAWKCLGAN | 0.100 |
| 138 | LLKSQAASGT | 0.100 |
| 110 | ALKAANSWRN | 0.100 |
| 144 | ASGTLSLAFT | 0.100 |

TABLE XVII-continued

V7C-HLA-A24-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 74 | GIRNKSSSSS | 0.100 |
| 81 | SSSQIPVVGV | 0.100 |
| 166 | WMKLETIILS | 0.100 |
| 72 | ESGIRNKSSS | 0.100 |
| 58 | AMWTEEAGAT | 0.100 |
| 133 | EFLLRLLKSQ | 0.090 |
| 159 | EFLGSGTWMK | 0.075 |
| 158 | GEFLGSGTWM | 0.050 |
| 50 | PLSTPPPPAM | 0.050 |
| 47 | KIPPLSTPPP | 0.036 |
| 22 | KCLGANILRG | 0.030 |
| 118 | RNPVLPHTNG | 0.030 |
| 109 | RALKAANSWR | 0.030 |
| 137 | RLLKSQAASG | 0.030 |
| 96 | EAQDSIDPPE | 0.025 |
| 172 | IILSKLTQEQ | 0.024 |

TABLE XVIII

V1-HLA-B7-
9mers-98P4B6
Each peptide is a portion of
SEQ ID NO: 3; each start
position is specified, the
length of peptide is 9 amino
acids, and the end position
for each peptide is the start
position plus eight.

| Start | Subsequence | Score |
|---|---|---|
| 173 | QARQQVIEL | 120.000 |
| 214 | GPVVVAISL | 80.000 |
| 259 | LPIVAITLL | 80.000 |
| 428 | TPPNFVLAL | 80.000 |
| 438 | LPSIVILDL | 80.000 |
| 291 | FPPWLETWL | 80.000 |
| 300 | QCRKQLGLL | 40.000 |
| 125 | YPESNAEYL | 24.000 |
| 177 | QVIELARQL | 20.000 |

TABLE XVIII-continued

V1-HLA-B7-
9mers-98P4B6
Each peptide is a portion of
SEQ ID NO: 3; each start
position is specified, the
length of peptide is 9 amino
acids, and the end position
for each peptide is the start
position plus eight.

| Start | Subsequence | Score |
|---|---|---|
| 148 | VVSAWALQL | 20.000 |
| 261 | IVAITLLSL | 20.000 |
| 75 | DVTHHEDAL | 20.000 |
| 441 | IVILDLLQL | 20.000 |
| 436 | LPLPSIVIL | 20.000 |
| 41 | FAKSLTIRL | 12.000 |
| 313 | AMVHVAYSL | 12.000 |
| 133 | LASLFPDSL | 12.000 |
| 5 | SMMGSPKSL | 12.000 |
| 27 | DARKVTVGV | 6.000 |
| 100 | SLWDLRHLL | 6.000 |
| 146 | FNVVSAWAL | 4.000 |
| 220 | ISLATFFFL | 4.000 |
| 187 | FIPIDLGSL | 4.000 |
| 128 | SNAEYLASL | 4.000 |
| 363 | FGIMSLGLL | 4.000 |
| 274 | GLLAAAYQL | 4.000 |
| 365 | IMSLGLLSL | 4.000 |
| 366 | MSLGLLSLL | 4.000 |
| 184 | QLNFIPIDL | 4.000 |
| 93 | IHREHYTSL | 4.000 |
| 324 | PMRRSERYL | 4.000 |
| 395 | QSTLGYVAL | 4.000 |
| 267 | LSLVYLAGL | 4.000 |
| 268 | SLVYLAGLL | 4.000 |
| 360 | YISFGIMSL | 4.000 |
| 196 | SSAREIENL | 4.000 |
| 378 | SIPSVSNAL | 4.000 |
| 258 | TLPIVAITL | 4.000 |
| 299 | LQCRKQLGL | 4.000 |
| 99 | TSLWDLRHL | 4.000 |
| 403 | LLISTFHVL | 4.000 |
| 37 | GSGDFAKSL | 4.000 |
| 203 | NLPLRLFTL | 4.000 |

TABLE XVIII-continued

V1-HLA-B7-9mers-98P4B6

Each peptide is a portion of SEQ ID NO: 3; each start position is specified, the length of peptide is 9 amino acids, and the end position for each peptide is the start position plus eight.

| Start | Subsequence | Score |
|---|---|---|
| 264 | ITLLSLVYL | 4.000 |
| 396 | STLGYVALL | 4.000 |
| 287 | KYRRFPPWL | 4.000 |
| 157 | GPKDASRQV | 4.000 |
| 317 | VAYSLCLPM | 3.000 |
| 9 | SPKSLSETC | 2.000 |
| 250 | IPIEIVNKT | 2.000 |
| 353 | EVWRIEMYI | 2.000 |
| 49 | LIRCGYHVV | 2.000 |
| 164 | QVYICSNNI | 2.000 |
| 134 | ASLFPDSLI | 1.800 |
| 435 | ALVLPSIVI | 1.800 |
| 200 | EIENLPLRL | 1.200 |
| 81 | DALTKTNII | 1.200 |
| 323 | LPMRRSERY | 1.200 |
| 108 | LVGKILIDV | 1.000 |
| 358 | EMYISFGIM | 1.000 |
| 112 | ILIDVSNNM | 1.000 |
| 254 | IVNKTLPIV | 1.000 |
| 231 | FVRDVIHPY | 1.000 |
| 328 | SERYLFLNM | 1.000 |
| 306 | GLLSFFFAM | 1.000 |
| 278 | AAYQLYYGT | 0.900 |
| 402 | ALLISTFHV | 0.600 |
| 297 | TWLQCRKQL | 0.600 |
| 262 | VAITLLSLV | 0.600 |
| 239 | YARNQQSDF | 0.600 |
| 434 | LALVLPSIV | 0.600 |
| 65 | FASEFFPHV | 0.600 |
| 161 | ASRQVYICS | 0.600 |
| 426 | FYTPPNFVL | 0.600 |
| 374 | LAVTSIPSV | 0.600 |
| 314 | MVHVAYSLC | 0.500 |

TABLE XVIII-continued

V1-HLA-B7-9mers-98P4B6

Each peptide is a portion of SEQ ID NO: 3; each start position is specified, the length of peptide is 9 amino acids, and the end position for each peptide is the start position plus eight.

| Start | Subsequence | Score |
|---|---|---|
| 34 | GVIGSGDFA | 0.500 |
| 216 | VVVAISLAT | 0.500 |
| 269 | LVYLAGLLA | 0.500 |
| 237 | HPYARNQQS | 0.400 |
| 371 | LSLLAVTSI | 0.400 |
| 85 | KTNIIFVAI | 0.400 |
| 390 | EFSFIQSTL | 0.400 |
| 439 | PSIVILDLL | 0.400 |
| 397 | TLGYVALLI | 0.400 |
| 430 | PNFVLALVL | 0.400 |
| 362 | SFGIMSLGL | 0.400 |
| 171 | NIQARQQVI | 0.400 |
| 180 | ELARQLNFI | 0.400 |
| 193 | GSLSSAREI | 0.400 |
| 386 | LNWREFSFI | 0.400 |
| 204 | LPLRLFTLW | 0.400 |
| 429 | PPNFVLALV | 0.400 |
| 188 | IPIDLGSLS | 0.400 |
| 379 | IPSVSNALN | 0.400 |
| 62 | NPKFASEFF | 0.400 |
| 326 | RRSERYLFL | 0.400 |
| 433 | VLALVLPSI | 0.400 |
| 253 | EIVNKTLPI | 0.400 |
| 106 | HLLVGKILI | 0.400 |

TABLE XVIII

V2-HLA-B7-9mers-98P4B6

Each peptide is a portion of SEQ ID NO: 5; each start position is specified, the length of peptide is 9 amino acids, and the end position for each peptide is the start position plus eight.

| Start | Subsequence | Score |
|---|---|---|
| 3 | SPGLQALSL | 80.000 |
| 35 | PPCPADFFL | 8.000 |

TABLE XVIII-continued

V2-HLA-B7-
9mers-98P4B6
Each peptide is a portion of
SEQ ID NO: 5; each start
position is specified, the
length of peptide is 9 amino
acids, and the end position
for each peptide is the start
position plus eight.

| Start | Subsequence | Score |
|---|---|---|
| 15 | SGFTPFSCL | 6.000 |
| 1 | SGSPGLQAL | 4.000 |
| 17 | FTPFSCLSL | 4.000 |
| 5 | GLQALSLSL | 4.000 |
| 25 | LPSSWDYRC | 2.000 |
| 37 | CPADFFLYF | 0.400 |
| 33 | CPPPCPADF | 0.400 |
| 18 | TPFSCLSLP | 0.200 |
| 10 | SLSLSSGFT | 0.100 |
| 14 | SSGFTPFSC | 0.100 |
| 7 | QALSLSLSS | 0.060 |
| 34 | PPPCPADFF | 0.060 |
| 8 | ALSLSLSSG | 0.030 |
| 23 | LSLPSSWDY | 0.020 |
| 12 | SLSSGFTPF | 0.020 |
| 21 | SCLSLPSSW | 0.020 |
| 6 | LQALSLSLS | 0.020 |
| 13 | LSSGFTPFS | 0.020 |
| 2 | GSPGLQALS | 0.020 |
| 9 | LSLSLSSGF | 0.020 |
| 20 | FSCLSLPSS | 0.020 |
| 32 | RCPPPCPAD | 0.015 |
| 22 | CLSLPSSWD | 0.015 |
| 31 | YRCPPPCPA | 0.015 |
| 30 | DYRCPPPCP | 0.015 |
| 27 | SSWDYRCPP | 0.015 |
| 29 | WDYRCPPPC | 0.010 |
| 24 | SLPSSWDYR | 0.010 |
| 11 | LSLSSGFTP | 0.010 |
| 36 | PCPADFFLY | 0.002 |
| 16 | GFTPFSCLS | 0.002 |
| 4 | PGLQALSLS | 0.002 |
| 26 | PSSWDYRCP | 0.001 |

TABLE XVIII-continued

V2-HLA-B7-
9mers-98P4B6
Each peptide is a portion of
SEQ ID NO: 5; each start
position is specified, the
length of peptide is 9 amino
acids, and the end position
for each peptide is the start
position plus eight.

| Start | Subsequence | Score |
|---|---|---|
| 28 | SWDYRCPPP | 0.000 |
| 19 | PFSCLSLPS | 0.000 |

TABLE XVIII

V5A-HLA-B7-
9mers-98P4B6
Each peptide is a portion of
SEQ ID NO: 11; each start
position is specified, the
length of peptide is 9 amino
acids, and the end position
for each peptide is the start
position plus eight.

| Start | Subsequence | Score |
|---|---|---|
| 2 | LPLRLFTFW | 0.400 |
| 7 | FTFWRGPVV | 0.200 |
| 9 | FWRGPVVVA | 0.150 |
| 6 | LFTFWRGPV | 0.030 |
| 8 | TFWRGPVVV | 0.020 |
| 1 | NLPLRLFTF | 0.020 |
| 3 | PLRLFTFWR | 0.010 |
| 5 | RLFTFWRGP | 0.010 |
| 4 | LRLFTFWRG | 0.001 |

TABLE XVIII

V5B-HLA-B7-
9mers-98P4B6
Each peptide is a portion of
SEQ ID NO: 11; each start
position is specified, the
length of peptide is 9 amino
acids, and the end position
for each peptide is the start
position plus eight.

| Start | Subsequence | Score |
|---|---|---|
| 24 | FVFLLTLLL | 20.000 |
| 14 | ADTQTELEL | 1.200 |
| 19 | ELELEFVFL | 1.200 |
| 12 | SFADTQTEL | 0.400 |
| 23 | EFVFLLTLL | 0.400 |
| 22 | LEFVFLLTL | 0.400 |

TABLE XVIII-continued

V5B-HLA-B7-9mers-98P4B6

Each peptide is a portion of SEQ ID NO: 11; each start position is specified, the length of peptide is 9 amino acids, and the end position for each peptide is the start position plus eight.

| Start | Subsequence | Score |
|---|---|---|
| 20 | LELEFVFLL | 0.400 |
| 10 | FCSFADTQT | 0.100 |
| 8 | QIFCSFADT | 0.100 |
| 6 | FIQIFCSFA | 0.100 |
| 17 | QTELELEFV | 0.060 |
| 21 | ELEFVFLLT | 0.030 |
| 4 | FSFIQIFCS | 0.020 |
| 16 | TQTELELEF | 0.020 |
| 1 | WREFSFIQI | 0.012 |
| 11 | CSFADTQTE | 0.010 |
| 3 | EFSFIQIFC | 0.010 |
| 7 | IQIFCSFAD | 0.010 |
| 15 | DTQTELELE | 0.010 |
| 13 | FADTQTELE | 0.009 |
| 5 | SFIQIFCSF | 0.002 |
| 2 | REFSFIQIF | 0.002 |
| 18 | TELELEFVF | 0.002 |
| 9 | IFCSFADTQ | 0.001 |

TABLE XVIII

V6-HLA-B7-9mers-98P4B6

Each peptide is a portion of SEQ ID NO: 13; each start position is specified, the length of peptide is 9 amino acids, and the end position for each peptide is the start position plus eight.

| Start | Subsequence | Score |
|---|---|---|
| 5 | IVILGKIIL | 20.000 |
| 14 | FLPCISRKL | 4.000 |
| 43 | IPHVSPERV | 4.000 |
| 7 | ILGKIILFL | 4.000 |
| 27 | KGWEKSQFL | 4.000 |
| 45 | HVSPERVTV | 1.500 |
| 46 | VSPERVTVM | 1.000 |

TABLE XVIII-continued

V6-HLA-B7-9mers-98P4B6

Each peptide is a portion of SEQ ID NO: 13; each start position is specified, the length of peptide is 9 amino acids, and the end position for each peptide is the start position plus eight.

| Start | Subsequence | Score |
|---|---|---|
| 31 | KSQFLEEGI | 0.400 |
| 4 | SIVILGKII | 0.400 |
| 17 | CISRKLKRI | 0.400 |
| 10 | KIILFLPCI | 0.400 |
| 15 | LPCISRKLK | 0.300 |
| 38 | GIGGTIPHV | 0.200 |
| 2 | LPSIVILGK | 0.200 |
| 18 | ISRKLKRIK | 0.100 |
| 3 | PSIVILGKI | 0.040 |
| 34 | FLEEGIGGT | 0.030 |
| 11 | IILFLPCIS | 0.020 |
| 39 | IGGTIPHVS | 0.020 |
| 6 | VILGKIILF | 0.020 |
| 24 | RIKKGWEKS | 0.020 |
| 21 | KLKRIKKGW | 0.020 |
| 40 | GGTIPHVSP | 0.015 |
| 12 | ILFLPCISR | 0.015 |
| 35 | LEEGIGGTI | 0.012 |
| 37 | EGIGGTIPH | 0.010 |
| 22 | LKRIKKGWE | 0.010 |
| 8 | LGKIILFLP | 0.010 |
| 32 | SQFLEEGIG | 0.010 |
| 41 | GTIPHVSPE | 0.010 |
| 1 | VLPSIVILG | 0.010 |
| 9 | GKIILFLPC | 0.010 |
| 42 | TIPHVSPER | 0.010 |
| 26 | KKGWEKSQF | 0.002 |
| 19 | SRKLKRIKK | 0.002 |
| 44 | PHVSPERVT | 0.002 |
| 36 | EEGIGGTIP | 0.001 |
| 20 | RKLKRIKKG | 0.001 |
| 29 | WEKSQFLEE | 0.001 |
| 13 | LFLPCISRK | 0.001 |
| 25 | IKKGWEKSQ | 0.001 |

TABLE XVIII-continued

V6-HLA-B7-9mers-98P4B6
Each peptide is a portion of SEQ ID NO: 13; each start position is specified, the length of peptide is 9 amino acids, and the end position for each peptide is the start position plus eight.

| Start | Subsequence | Score |
|---|---|---|
| 30 | EKSQFLEEG | 0.001 |
| 33 | QFLEEGIGG | 0.001 |
| 23 | KRIKKGWEK | 0.001 |
| 16 | PCISRKLKR | 0.001 |
| 28 | GWEKSQFLE | 0.000 |

TABLE XVIII

V7A-HLA-B7-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 9 | FLPNGINGI | 0.400 |
| 1 | SPKSLSETF | 0.400 |
| 6 | SETFLPNGI | 0.040 |
| 2 | PKSLSETFL | 0.040 |
| 7 | ETFLPNGIN | 0.030 |
| 4 | SLSETFLPN | 0.020 |
| 3 | KSLSETFLP | 0.010 |
| 5 | LSETFLPNG | 0.003 |
| 8 | TFLPNGING | 0.001 |

TABLE XVIII

V7B-HLA-B7-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 9 | STLGYVALL | 4.000 |
| 8 | QSTLGYVAL | 4.000 |
| 3 | NMAYQQSTL | 4.000 |

TABLE XVIII-continued

V7B-HLA-B7-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 2 | LNMAYQQST | 0.300 |
| 6 | YQQSTLGYV | 0.200 |
| 7 | QQSTLGYVA | 0.100 |
| 4 | MAYQQSTLG | 0.030 |
| 1 | FLNMAYQQS | 0.020 |
| 5 | AYQQSTLGY | 0.006 |

TABLE XVIII

V7C-HLA-B7-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 15 | SPAAAWKCL | 80.000 |
| 126 | GVGPLWEFL | 20.000 |
| 24 | GANILRGGL | 18.000 |
| 113 | ANSWRNPVL | 12.000 |
| 141 | QAASGTLSL | 12.000 |
| 127 | VGPLWEFLL | 4.000 |
| 148 | SLAFTSWSL | 4.000 |
| 181 | KSKHCMFSL | 4.000 |
| 29 | RGGLSEIVL | 4.000 |
| 139 | KSQAASGTL | 4.000 |
| 27 | ILRGGLSEI | 4.000 |
| 165 | WMKLETIIL | 4.000 |
| 152 | TSWSLGEFL | 4.000 |
| 160 | LGSGTWMKL | 4.000 |
| 102 | PPESPDRAL | 3.600 |
| 52 | TPPPPAMWT | 3.000 |
| 112 | AANSWRNPV | 2.700 |
| 101 | DPPESPDRA | 2.000 |
| 50 | LSTPPPPAM | 1.500 |

TABLE XVIII-continued

V7C-HLA-B7-
9mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 5 | ILDLSVEVL | 1.200 |
| 42 | QQDRKIPPL | 1.200 |
| 134 | LLRLLKSQA | 1.000 |
| 142 | AASGTLSLA | 0.900 |
| 17 | AAAWKCLGA | 0.900 |
| 105 | SPDRALKAA | 0.600 |
| 11 | EVLASPAAA | 0.500 |
| 88 | GVVTEDDEA | 0.500 |
| 31 | GLSEIVLPI | 0.400 |
| 20 | WKCLGANIL | 0.400 |
| 168 | LETIILSKL | 0.400 |
| 163 | GTWMKLETI | 0.400 |
| 129 | PLWEFLLRL | 0.400 |
| 66 | TAEAQESGI | 0.360 |
| 81 | SSQIPVVGV | 0.300 |
| 57 | AMWTEEAGA | 0.300 |
| 14 | ASPAAAWKC | 0.300 |
| 118 | NPVLPHTNG | 0.300 |
| 84 | IPVVGVVTE | 0.200 |
| 79 | SSSSQIPVV | 0.200 |
| 55 | PPAMWTEEA | 0.200 |
| 82 | SQIPVVGVV | 0.200 |
| 37 | LPIEWQQDR | 0.200 |
| 78 | SSSSSQIPV | 0.200 |
| 73 | GIRNKSSSS | 0.200 |
| 4 | VILDLSVEV | 0.200 |
| 2 | SIVILDLSV | 0.200 |
| 47 | IPPLSTPPP | 0.200 |
| 128 | GPLWEFLLR | 0.200 |
| 121 | LPHTNGVGP | 0.200 |
| 18 | AAWKCLGAN | 0.180 |
| 9 | SVEVLASPA | 0.150 |
| 164 | TWMKLETII | 0.120 |

TABLE XVIII-continued

V7C-HLA-B7-
9mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 19 | AWKCLGANI | 0.120 |
| 130 | LWEFLLRLL | 0.120 |
| 104 | ESPDRALKA | 0.100 |
| 158 | EFLGSGTWM | 0.100 |
| 162 | SGTWMKLET | 0.100 |
| 169 | ETIILSKLT | 0.100 |
| 83 | QIPVVGVVT | 0.100 |
| 178 | QEQKSKHCM | 0.100 |
| 144 | SGTLSLAFT | 0.100 |
| 119 | PVLPHTNGV | 0.100 |
| 143 | ASGTLSLAF | 0.060 |
| 64 | GATAEAQES | 0.060 |
| 68 | EAQESGIRN | 0.060 |
| 25 | ANILRGGLS | 0.060 |
| 108 | RALKAANSW | 0.060 |
| 35 | IVLPIEWQQ | 0.050 |
| 86 | VVGVVTEDD | 0.050 |
| 3 | IVILDLSVE | 0.050 |
| 89 | VVTEDDEAQ | 0.050 |
| 122 | PHTNGVGPL | 0.040 |
| 76 | NKSSSSSQI | 0.040 |
| 182 | SKHCMFSLI | 0.040 |
| 39 | IEWQQDRKI | 0.040 |
| 12 | VLASPAAAW | 0.030 |
| 62 | EAGATAEAQ | 0.030 |
| 125 | NGVGPLWEF | 0.030 |
| 13 | LASPAAAWK | 0.030 |
| 109 | ALKAANSWR | 0.030 |
| 63 | AGATAEAQE | 0.030 |
| 95 | EAQDSIDPP | 0.030 |
| 65 | ATAEAQESG | 0.030 |
| 149 | LAFTSWSLG | 0.030 |
| 111 | KAANSWRNP | 0.030 |
| 51 | STPPPPAMW | 0.030 |

TABLE XVIII-continued

V7C-HLA-B7-
9mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 184 | HCMFSLISG | 0.030 |
| 59 | WTEEAGATA | 0.030 |
| 156 | LGEFLGSGT | 0.030 |
| 177 | TQEQKSKHC | 0.030 |
| 140 | SQAASGTLS | 0.020 |
| 48 | PPLSTPPPP | 0.020 |
| 71 | ESGIRNKSS | 0.020 |
| 123 | HTNGVGPLW | 0.020 |
| 72 | SGIRNKSSS | 0.020 |
| 179 | EQKSKHCMF | 0.020 |
| 185 | CMFSLISGS | 0.020 |
| 54 | PPPAMWTEE | 0.020 |
| 147 | LSLAFTSWS | 0.020 |
| 28 | LRGGLSEIV | 0.020 |

TABLE XIX

V1-HLA-B7-
10mers-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 323 | LPMRRSERYL | 240.000 |
| 197 | SAREIENLPL | 120.000 |
| 438 | LPSIVILDLL | 80.000 |
| 9 | SPKSLSETCL | 80.000 |
| 250 | IPIEIVNKTL | 80.000 |
| 312 | FAMVHVAYSL | 36.000 |
| 147 | NVVSAWALQL | 20.000 |
| 314 | MVHVAYSLCL | 20.000 |
| 364 | GIMSLGLLSL | 12.000 |
| 263 | AITLLSLVYL | 12.000 |
| 219 | AISLATFFFL | 12.000 |
| 402 | ALLISTFHVL | 12.000 |
| 435 | ALVLPSIVIL | 12.000 |
| 273 | AGLLAAAYQL | 12.000 |
| 4 | ISMMGSPKSL | 12.000 |
| 92 | AIHREHYTSL | 12.000 |
| 27 | DARKVTVGVI | 12.000 |
| 181 | LARQLNFIPI | 12.000 |
| 429 | PPNFVLALVL | 8.000 |
| 296 | ETWLQCRKQL | 6.000 |
| 99 | TSLWDLRHLL | 6.000 |
| 316 | HVAYSLCLPM | 5.000 |
| 231 | FVRDVIHPYA | 5.000 |
| 195 | LSSAREIENL | 4.000 |
| 257 | KTLPIVAITL | 4.000 |
| 377 | TSIPSVSNAL | 4.000 |
| 266 | LLSLVYLAGL | 4.000 |
| 202 | ENLPLRLFTL | 4.000 |
| 132 | YLASLFPDSL | 4.000 |
| 299 | LQCRKQLGLL | 4.000 |
| 176 | QQVIELARQL | 4.000 |
| 427 | YTPPNFVLAL | 4.000 |
| 394 | IQSTLGYVAL | 4.000 |
| 213 | RGPVVVAISL | 4.000 |
| 365 | IMSLGLLSLL | 4.000 |
| 49 | LIRCGYHVVI | 4.000 |
| 428 | TPPNFVLALV | 4.000 |
| 103 | DLRHLLVGKI | 4.000 |
| 36 | IGSGDFAKSL | 4.000 |
| 98 | YTSLWDLRHL | 4.000 |
| 298 | WLQCRKQLGL | 4.000 |
| 325 | MRRSERYLFL | 4.000 |
| 361 | ISFGIMSLGL | 4.000 |
| 258 | TLPIVAITLL | 4.000 |

TABLE XIX-continued

V1-HLA-B7-
10mers-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 172 | IQARQQVIEL | 4.000 |
| 127 | ESNAEYLASL | 4.000 |
| 440 | SIVILDLLQL | 4.000 |
| 183 | RQLNFIPIDL | 4.000 |
| 267 | LSLVYLAGLL | 4.000 |
| 437 | VLPSIVILDL | 4.000 |
| 395 | QSTLGYVALL | 4.000 |
| 173 | QARQQVIELA | 3.000 |
| 432 | FVLALVLPSI | 2.000 |
| 214 | GPVVVAISLA | 2.000 |
| 434 | LALVLPSIVI | 1.800 |
| 133 | LASLFPDSLI | 1.800 |
| 385 | ALNWREFSFI | 1.200 |
| 336 | MAYQQVHANI | 1.200 |
| 41 | FAKSLTIRLI | 1.200 |
| 111 | KILIDVSNNM | 1.000 |
| 261 | IVAITLLSLV | 1.000 |
| 305 | LGLLSFFFAM | 1.000 |
| 277 | AAAYQLYYGT | 0.900 |
| 161 | ASRQVYICSN | 0.600 |
| 239 | YARNQQSDFY | 0.600 |
| 255 | VNKTLPIVAI | 0.600 |
| 401 | VALLISTFHV | 0.600 |
| 125 | YPESNAEYLA | 0.600 |
| 157 | GPKDASRQVY | 0.600 |
| 227 | FLYSFVRDVI | 0.600 |
| 82 | ALTKTNIIFV | 0.600 |
| 425 | RFYTPPNFVL | 0.600 |
| 65 | FASEFFPHVV | 0.600 |
| 134 | ASLFPDSLIV | 0.600 |
| 223 | ATFFFLYSFV | 0.600 |
| 269 | LVYLAGLLAA | 0.500 |
| 142 | IVKGFNVVSA | 0.500 |
| 75 | DVTHHEDALT | 0.500 |

TABLE XIX-continued

V1-HLA-B7-
10mers-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 441 | IVILDLLQLC | 0.500 |
| 409 | HVLIYGWKRA | 0.500 |
| 254 | IVNKTLPIVA | 0.500 |
| 90 | FVAIHREHYT | 0.500 |
| 375 | AVTSIPSVSN | 0.450 |
| 199 | REIENLPLRL | 0.400 |
| 95 | REHYTSLWDL | 0.400 |
| 379 | IPSVSNALNW | 0.400 |
| 259 | LPIVAITLLS | 0.400 |
| 211 | LWRGPVVVAI | 0.400 |
| 163 | RQVYICSNNI | 0.400 |
| 145 | GFNVVSAWAL | 0.400 |
| 186 | NFIPIDLGSL | 0.400 |
| 188 | IPIDLGSLSS | 0.400 |
| 370 | LLSLLAVTSI | 0.400 |
| 359 | MYISFGIMSL | 0.400 |
| 16 | TCLPNGINGI | 0.400 |
| 124 | QYPESNAEYL | 0.400 |
| 170 | NNIQARQQVI | 0.400 |
| 243 | QQSDFYKIPI | 0.400 |
| 241 | RNQQSDFYKI | 0.400 |
| 74 | VDVTHHEDAL | 0.400 |

TABLE XIX

V2-HLA-B7-
10mers-98P4B6
Each peptide is a portion of
SEQ ID NO: 5; each start
position is specified, the
length of peptide is 10 amino
acids, and the end position
for each peptide is the start
position plus nine.

| Start | Subsequence | Score |
|---|---|---|
| 34 | PPPCPADFFL | 8.000 |
| 14 | SSGFTPFSCL | 6.000 |
| 2 | GSPGLQALSL | 4.000 |

TABLE XIX-continued

V2-HLA-B7-10mers-98P4B6

Each peptide is a portion of SEQ ID NO: 5; each start position is specified, the length of peptide is 10 amino acids, and the end position for each peptide is the start position plus nine.

| Start | Subsequence | Score |
|---|---|---|
| 33 | CPPPCPADFF | 0.600 |
| 18 | TPFSCLSLPS | 0.400 |
| 16 | GFTPFSCLSL | 0.400 |
| 3 | SPGLQALSLS | 0.400 |
| 4 | PGLQALSLSL | 0.400 |
| 25 | LPSSWDYRCP | 0.200 |
| 30 | DYRCPPPCPA | 0.150 |
| 24 | SLPSSWDYRC | 0.100 |
| 13 | LSSGFTPFSC | 0.100 |
| 9 | LSLSSGFT | 0.100 |
| 8 | ALSLSLSSGF | 0.060 |
| 35 | PPCPADFFLY | 0.040 |
| 7 | QALSLSLSSG | 0.030 |
| 15 | SGFTPFSCLS | 0.020 |
| 22 | CLSLPSSWDY | 0.020 |
| 11 | LSLSSGFTPF | 0.020 |
| 6 | LQALSLSLSS | 0.020 |
| 32 | RCPPPCPADF | 0.020 |
| 1 | SGSPGLQALS | 0.020 |
| 20 | FSCLSLPSSW | 0.020 |
| 12 | SLSSGFTPFS | 0.020 |
| 5 | GLQALSLSLS | 0.020 |
| 21 | SCLSLPSSWD | 0.015 |
| 10 | SLSLSSGFTP | 0.010 |
| 17 | FTPFSCLSLP | 0.010 |
| 27 | SSWDYRCPPP | 0.010 |
| 23 | LSLPSSWDYR | 0.010 |
| 28 | SWDYRCPPPC | 0.003 |
| 36 | PCPADFFLYF | 0.002 |
| 26 | PSSWDYRCPP | 0.002 |
| 31 | YRCPPPCPAD | 0.002 |
| 29 | WDYRCPPPCP | 0.002 |
| 19 | PFSCLSLPSS | 0.000 |

TABLE XIX

V5A-HLA-B7-10mers-98P4B6

Each peptide is a portion of SEQ ID NO: 11; each start position is specified, the length of peptide is 10 amino acids, and the end position for each peptide is the start position plus nine.

| Start | Subsequence | Score |
|---|---|---|
| 10 | FWRGPVVVAI | 0.400 |
| 6 | RLFTFWRGPV | 0.300 |
| 8 | FTFWRGPVVV | 0.200 |
| 3 | LPLRLFTFWR | 0.200 |
| 2 | NLPLRLFTFW | 0.020 |
| 7 | LFTFWRGPVV | 0.020 |
| 1 | ENLPLRLFTF | 0.020 |
| 9 | TFWRGPVVVA | 0.015 |
| 4 | PLRLFTFWRG | 0.010 |
| 5 | LRLFTFWRGP | 0.001 |

TABLE XIX

V5B-HLA-B7-10mers-98P4B6

Each peptide is a portion of SEQ ID NO: 11; each start position is specified, the length of peptide is 10 amino acids, and the end position for each peptide is the start position plus nine.

| Start | Subsequence | Score |
|---|---|---|
| 12 | CSFADTQTEL | 4.000 |
| 14 | FADTQTELEL | 3.600 |
| 20 | ELELEFVFLL | 1.200 |
| 22 | ELEFVFLLTL | 1.200 |
| 23 | LEFVFLLTLL | 0.400 |
| 1 | NWREFSFIQI | 0.400 |
| 19 | TELELEFVFL | 0.400 |
| 24 | EFVFLLTLLL | 0.400 |
| 17 | TQTELELEFV | 0.200 |
| 8 | IQIFCSFADT | 0.100 |
| 5 | FSFIQIFCSF | 0.020 |
| 16 | DTQTELELEF | 0.020 |
| 10 | IFCSFADTQT | 0.010 |
| 21 | LELEFVFLLT | 0.010 |
| 6 | SFIQIFCSFA | 0.010 |

TABLE XIX-continued

V5B-HLA-B7-
10mers-98P4B6
Each peptide is a portion of
SEQ ID NO: 11; each start
position is specified, the
length of peptide is 10 amino
acids, and the end position
for each peptide is the start
position plus nine.

| Start | Subsequence | Score |
|---|---|---|
| 3 | REFSFIQIFC | 0.010 |
| 9 | QIFCSFADTQ | 0.010 |
| 7 | FIQIFCSFAD | 0.010 |
| 11 | FCSFADTQTE | 0.010 |
| 18 | QTELELEFVF | 0.006 |
| 15 | ADTQTELELE | 0.003 |
| 4 | EFSFIQIFCS | 0.002 |
| 13 | SFADTQTELE | 0.001 |
| 2 | WREFSFIQIF | 0.001 |

TABLE XIX

V6-HLA-B7-
10mers-98P4B6
Each peptide is a portion of
SEQ ID NO: 13; each start
position is specified, the
length of peptide is 10 amino
acids, and the end position
for each peptide is the start
position plus nine.

| Start | Subsequence | Score |
|---|---|---|
| 3 | LPSIVILGKI | 8.000 |
| 46 | HVSPERVTVM | 5.000 |
| 5 | SIVILGKIIL | 4.000 |
| 7 | VILGKIILFL | 4.000 |
| 44 | IPHVSPERVT | 3.000 |
| 14 | LFLPCISRKL | 0.400 |
| 27 | KKGWEKSQFL | 0.400 |
| 16 | LPCISRKLKR | 0.200 |
| 43 | TIPHVSPERV | 0.200 |
| 38 | EGIGGTIPHV | 0.200 |
| 19 | ISRKLKRIKK | 0.150 |
| 35 | FLEEGIGGTI | 0.120 |
| 9 | LGKIILFLPC | 0.100 |
| 6 | IVILGKIILF | 0.100 |
| 1 | LVLPSIVILG | 0.050 |
| 10 | GKIILFLPCI | 0.040 |

TABLE XIX-continued

V6-HLA-B7-
10mers-98P4B6
Each peptide is a portion of
SEQ ID NO: 13; each start
position is specified, the
length of peptide is 10 amino
acids, and the end position
for each peptide is the start
position plus nine.

| Start | Subsequence | Score |
|---|---|---|
| 4 | PSIVILGKII | 0.040 |
| 31 | EKSQFLEEGI | 0.040 |
| 17 | PCISRKLKRI | 0.040 |
| 11 | KIILFLPCIS | 0.020 |
| 39 | GIGGTIPHVS | 0.020 |
| 15 | FLPCISRKLK | 0.015 |
| 40 | IGGTIPHVSP | 0.015 |
| 12 | IILFLPCISR | 0.015 |
| 34 | QFLEEGIGGT | 0.010 |
| 2 | VLPSIVILGK | 0.010 |
| 33 | SQFLEEGIGG | 0.010 |
| 25 | RIKKGWEKSQ | 0.010 |
| 32 | KSQFLEEGIG | 0.010 |
| 13 | ILFLPCISRK | 0.010 |
| 22 | KLKRIKKGWE | 0.010 |
| 8 | ILGKIILFLP | 0.010 |
| 41 | GGTIPHVSPE | 0.010 |
| 18 | CISRKLKRIK | 0.010 |
| 28 | KGWEKSQFLE | 0.010 |
| 42 | GTIPHVSPER | 0.010 |
| 23 | LKRIKKGWEK | 0.010 |
| 45 | PHVSPERVTV | 0.003 |
| 24 | KRIKKGWEKS | 0.002 |
| 26 | IKKGWEKSQF | 0.002 |
| 21 | RKLKRIKKGW | 0.002 |
| 20 | SRKLKRIKKG | 0.001 |
| 37 | EEGIGGTIPH | 0.001 |
| 30 | WEKSQFLEEG | 0.001 |
| 29 | GWEKSQFLEE | 0.000 |
| 36 | LEEGIGGTIP | 0.000 |

TABLE XIX

V7A-HLA-B7-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 2 | SPKSLSETFL | 80.000 |
| 6 | LSETFLPNGI | 0.120 |
| 9 | TFLPNGINGI | 0.040 |
| 1 | GSPKSLSETF | 0.020 |
| 4 | KSLSETFLPN | 0.020 |
| 10 | FLPNGINGIK | 0.010 |
| 5 | SLSETFLPNG | 0.010 |
| 8 | ETFLPNGING | 0.010 |
| 7 | SETFLPNGIN | 0.003 |
| 3 | PKSLSETFLP | 0.000 |

TABLE XIX

V7B-HLA-B7-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 3 | LNMAYQQSTL | 12.000 |
| 8 | QQSTLGYVAL | 4.000 |
| 9 | QSTLGYVALL | 4.000 |
| 10 | STLGYVALLI | 0.400 |
| 7 | YQQSTLGYVA | 0.100 |
| 2 | FLNMAYQQST | 0.100 |
| 6 | AYQQSTLGYV | 0.060 |
| 5 | MAYQQSTLGY | 0.060 |
| 4 | NMAYQQSTLG | 0.010 |
| 1 | LFLNMAYQQS | 0.002 |

TABLE XIX

V7C-HLA-B7-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 102 | DPPESPDRAL | 120.000 |
| 122 | LPHTNGVGPL | 80.000 |
| 129 | GPLWEFLLRL | 80.000 |
| 113 | AANSWRNPVL | 36.000 |
| 127 | GVGPLWEFLL | 20.000 |
| 15 | ASPAAAWKCL | 12.000 |
| 24 | LGANILRGGL | 6.000 |
| 152 | FTSWSLGEFL | 4.000 |
| 42 | WQQDRKIPPL | 4.000 |
| 160 | FLGSGTWMKL | 4.000 |
| 5 | VILDLSVEVL | 4.000 |
| 126 | NGVGPLWEFL | 4.000 |
| 141 | SQAASGTLSL | 4.000 |
| 119 | NPVLPHTNGV | 4.000 |
| 148 | LSLAFTSWSL | 4.000 |
| 19 | AAWKCLGANI | 3.600 |
| 28 | ILRGGLSEIV | 2.000 |
| 168 | KLETIILSKL | 1.200 |
| 20 | AWKCLGANIL | 1.200 |
| 165 | TWMKLETIIL | 1.200 |
| 66 | ATAEAQESGI | 1.200 |
| 4 | IVILDLSVEV | 1.000 |
| 135 | LLRLLKSQAA | 1.000 |
| 112 | KAANSWRNPV | 0.900 |
| 164 | GTWMKLETII | 0.400 |
| 139 | LKSQAASGTL | 0.400 |
| 181 | QKSKHCMFSL | 0.400 |
| 76 | RNKSSSSSQI | 0.400 |
| 29 | LRGGLSEIVL | 0.400 |
| 1 | LPSIVILDLS | 0.400 |
| 130 | PLWEFLLRLL | 0.400 |
| 27 | NILRGGLSEI | 0.400 |
| 31 | GGLSEIVLPI | 0.400 |
| 163 | SGTWMKLETI | 0.400 |

TABLE XIX-continued

V7C-HLA-B7-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 182 | KSKHCMFSLI | 0.400 |
| 144 | ASGTLSLAFT | 0.300 |
| 49 | PPLSTPPPPA | 0.300 |
| 81 | SSSQIPVVGV | 0.300 |
| 142 | QAASGTLSLA | 0.300 |
| 14 | LASPAAAWKC | 0.300 |
| 58 | AMWTEEAGAT | 0.300 |
| 178 | TQEQKSKHCM | 0.300 |
| 16 | SPAAAWKCLG | 0.200 |
| 85 | IPVVGVVTED | 0.200 |
| 82 | SSQIPVVGVV | 0.200 |
| 48 | IPPLSTPPPP | 0.200 |
| 55 | PPPAMWTEEA | 0.200 |
| 78 | KSSSSSQIPV | 0.200 |
| 79 | SSSSSQIPVV | 0.200 |
| 74 | GIRNKSSSSS | 0.200 |
| 53 | TPPPPAMWTE | 0.200 |
| 38 | LPIEWQQDRK | 0.200 |
| 18 | AAAWKCLGAN | 0.180 |
| 143 | AASGTLSLAF | 0.180 |
| 50 | PLSTPPPPAM | 0.150 |
| 10 | SVEVLASPAA | 0.150 |
| 52 | STPPPPAMWT | 0.150 |
| 44 | QDRKIPPLST | 0.150 |
| 12 | EVLASPAAAW | 0.150 |
| 106 | SPDRALKAAN | 0.120 |
| 158 | GEFLGSGTWM | 0.100 |
| 156 | SLGEFLGSGT | 0.100 |
| 162 | GSGTWMKLET | 0.100 |
| 88 | VGVVTEDDEA | 0.100 |
| 134 | FLLRLLKSQA | 0.100 |
| 138 | LLKSQAASGT | 0.100 |
| 177 | LTQEQKSKHC | 0.100 |

TABLE XIX-continued

V7C-HLA-B7-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 83 | SQIPVVGVVT | 0.100 |
| 105 | ESPDRALKAA | 0.100 |
| 116 | SWRNPVLPHT | 0.100 |
| 9 | LSVEVLASPA | 0.100 |
| 57 | PAMWTEEAGA | 0.090 |
| 185 | HCMFSLISGS | 0.060 |
| 110 | ALKAANSWRN | 0.060 |
| 25 | GANILRGGLS | 0.060 |
| 64 | AGATAEAQES | 0.060 |
| 36 | IVLPIEWQQD | 0.050 |
| 87 | VVGVVTEDDE | 0.050 |
| 90 | VVTEDDEAQD | 0.050 |
| 89 | GVVTEDDEAQ | 0.050 |
| 150 | LAFTSWSLGE | 0.030 |
| 125 | TNGVGPLWEF | 0.030 |
| 109 | RALKAANSWR | 0.030 |
| 96 | EAQDSIDPPE | 0.030 |
| 63 | EAGATAEAQE | 0.030 |
| 26 | ANILRGGLSE | 0.030 |
| 51 | LSTPPPPAMW | 0.030 |
| 69 | EAQESGIRNK | 0.030 |
| 17 | PAAAWKCLGA | 0.030 |
| 65 | GATAEAQESG | 0.030 |
| 114 | ANSWRNPVLP | 0.030 |
| 6 | ILDLSVEVLA | 0.030 |
| 70 | AQESGIRNKS | 0.027 |
| 147 | TLSLAFTSWS | 0.020 |
| 146 | GTLSLAFTSW | 0.020 |
| 140 | KSQAASGTLS | 0.020 |
| 180 | EQKSKHCMFS | 0.020 |
| 56 | PPAMWTEEAG | 0.020 |
| 145 | SGTLSLAFTS | 0.020 |
| 72 | ESGIRNKSSS | 0.020 |

TABLE XX

V1-HLA-B3501-9mers-98P4B6

Each peptide is a portion of SEQ ID NO: 3; each start position is specified, the length of peptide is 9 amino acids, and the end position for each peptide is the start position plus eight.

| Start | Subsequence | Score |
|---|---|---|
| 62 | NPKFASEFF | 60.000 |
| 323 | LPMRRSERY | 40.000 |
| 157 | GPKDASRQV | 24.000 |
| 259 | LPIVAITLL | 20.000 |
| 428 | TPPNFVLAL | 20.000 |
| 291 | FPPWLETWL | 20.000 |
| 438 | LPSIVILDL | 20.000 |
| 214 | GPVVVAISL | 20.000 |
| 231 | FVRDVIHPY | 12.000 |
| 37 | GSGDFAKSL | 10.000 |
| 405 | ISTFHVLIY | 10.000 |
| 204 | LPLRLFTLW | 10.000 |
| 239 | YARNQQSDF | 9.000 |
| 41 | FAKSLTIRL | 9.000 |
| 173 | QARQQVIEL | 9.000 |
| 99 | TSLWDLRHL | 7.500 |
| 196 | SSAREIENL | 7.500 |
| 9 | SPKSLSETC | 6.000 |
| 317 | VAYSLCLPM | 6.000 |
| 276 | LAAAYQLYY | 6.000 |
| 272 | LAGLLAAAY | 6.000 |
| 125 | YPESNAEYL | 6.000 |
| 46 | TIRLIRCGY | 6.000 |
| 267 | LSLVYLAGL | 5.000 |
| 395 | QSTLGYVAL | 5.000 |
| 366 | MSLGLLSLL | 5.000 |
| 220 | ISLATFFFL | 5.000 |
| 250 | IPIEIVNKT | 4.000 |
| 112 | ILIDVSNNM | 4.000 |
| 188 | IPIDLGSLS | 4.000 |
| 347 | NSWNEEEVW | 3.750 |
| 133 | LASLFPDSL | 3.000 |
| 300 | QCRKQLGLL | 3.000 |
| 218 | VAISLATFF | 3.000 |
| 177 | QVIELARQL | 2.000 |
| 303 | KQLGLLSFF | 2.000 |
| 371 | LSLLAVTSI | 2.000 |
| 128 | SNAEYLASL | 2.000 |
| 275 | LLAAAYQLY | 2.000 |
| 61 | RNPKFASEF | 2.000 |
| 100 | SLWDLRHLL | 2.000 |
| 237 | HPYARNQQS | 2.000 |
| 379 | IPSVSNALN | 2.000 |
| 117 | SNNMRINQY | 2.000 |
| 306 | GLLSFFFAM | 2.000 |
| 134 | ASLFPDSLI | 2.000 |
| 221 | SLATFFFLY | 2.000 |
| 193 | GSLSSAREI | 2.000 |
| 263 | AITLLSLVY | 2.000 |
| 90 | FVAIHREHY | 2.000 |
| 280 | YQLYYGTKY | 2.000 |
| 358 | EMYISFGIM | 2.000 |
| 27 | DARKVTVGV | 1.800 |
| 441 | IVILDLLQL | 1.500 |
| 161 | ASRQVYICS | 1.500 |
| 59 | GSRNPKFAS | 1.500 |
| 187 | FIPIDLGSL | 1.500 |
| 81 | DALTKTNII | 1.200 |
| 65 | FASEFFPHV | 1.200 |
| 365 | IMSLGLLSL | 1.000 |
| 184 | QLNFIPIDL | 1.000 |
| 385 | ALNWREFSF | 1.000 |
| 148 | VVSAWALQL | 1.000 |
| 274 | GLLAAAYQL | 1.000 |
| 144 | KGFNVVSAW | 1.000 |
| 146 | FNVVSAWAL | 1.000 |
| 383 | SNALNWREF | 1.000 |

TABLE XX-continued

V1-HLA-B3501-
9mers-98P4B6
Each peptide is a portion of
SEQ ID NO: 3; each start
position is specified, the
length of peptide is 9 amino
acids, and the end position
for each peptide is the start
position plus eight.

| Start | Subsequence | Score |
|---|---|---|
| 304 | QLGLLSFFF | 1.000 |
| 363 | FGIMSLGLL | 1.000 |
| 217 | VVAISLATF | 1.000 |
| 57 | VIGSRNPKF | 1.000 |
| 313 | AMVHVAYSL | 1.000 |
| 411 | LIYGWKRAF | 1.000 |
| 378 | SIPSVSNAL | 1.000 |
| 264 | ITLLSLVYL | 1.000 |
| 75 | DVTHHEDAL | 1.000 |
| 436 | LVLPSIVIL | 1.000 |
| 82 | ALTKTNIIF | 1.000 |
| 403 | LLISTFHVL | 1.000 |
| 299 | LQCRKQLGL | 1.000 |
| 400 | YVALLISTF | 1.000 |
| 258 | TLPIVAITL | 1.000 |
| 268 | SLVYLAGLL | 1.000 |
| 5 | SMMGSPKSL | 1.000 |
| 223 | ATFFFLYSF | 1.000 |
| 33 | VGVIGSGDF | 1.000 |
| 396 | STLGYVALL | 1.000 |
| 261 | IVAITLLSL | 1.000 |
| 360 | YISFGIMSL | 1.000 |
| 219 | AISLATFFF | 1.000 |
| 203 | NLPLRLFTL | 1.000 |
| 129 | NAEYLASLF | 0.900 |
| 85 | KTNIIFVAI | 0.800 |
| 127 | ESNAEYLAS | 0.750 |
| 386 | LNWREFSFI | 0.600 |
| 434 | LALVLPSIV | 0.600 |
| 416 | KRAFEEEYY | 0.600 |
| 328 | SERYLFLNM | 0.600 |
| 287 | KYRRFPPWL | 0.600 |
| 24 | GIKDARKVT | 0.600 |

TABLE XX

V2-HLA-B3501-
9mers-98P4B6
Each peptide is a portion of
SEQ ID NO: 5; each start
position is specified, the
length of peptide is 9 amino
acids, and the end position
for each peptide is the start
position plus eight.

| Start | Subsequence | Score |
|---|---|---|
| 37 | CPADFFLYF | 40.000 |
| 33 | CPPPCPADF | 20.000 |
| 3 | SPGLQALSL | 20.000 |
| 23 | LSLPSSWDY | 10.000 |
| 9 | LSLSLSSGF | 5.000 |
| 35 | PPCPADFFL | 2.000 |
| 34 | PPPCPADFF | 2.000 |
| 25 | LPSSWDYRC | 2.000 |
| 15 | SGFTPFSCL | 1.000 |
| 1 | SGSPGLQAL | 1.000 |
| 12 | SLSSGFTPF | 1.000 |
| 5 | GLQALSLSL | 1.000 |
| 17 | FTPFSCLSL | 1.000 |
| 20 | FSCLSLPSS | 0.500 |
| 2 | GSPGLQALS | 0.500 |
| 13 | LSSGFTPFS | 0.500 |
| 14 | SSGFTPFSC | 0.500 |
| 21 | SCLSLPSSW | 0.500 |
| 7 | QALSLSLSS | 0.300 |
| 36 | PCPADFFLY | 0.300 |
| 18 | TPFSCLSLP | 0.200 |
| 6 | LQALSLSLS | 0.100 |
| 10 | SLSLSSGFT | 0.100 |
| 27 | SSWDYRCPP | 0.100 |
| 11 | LSLSSGFTP | 0.050 |
| 32 | RCPPPCPAD | 0.020 |
| 8 | ALSLSLSSG | 0.010 |
| 22 | CLSLPSSWD | 0.010 |
| 29 | WDYRCPPPC | 0.010 |
| 24 | SLPSSWDYR | 0.010 |
| 31 | YRCPPPCPA | 0.010 |
| 4 | PGLQALSLS | 0.010 |
| 16 | GFTPFSCLS | 0.010 |
| 26 | PSSWDYRCP | 0.008 |

TABLE XX-continued

V2-HLA-B3501-
9mers-98P4B6
Each peptide is a portion of
SEQ ID NO: 5; each start
position is specified, the
length of peptide is 9 amino
acids, and the end position
for each peptide is the start
position plus eight.

| Start | Subsequence | Score |
|---|---|---|
| 30 | DYRCPPPCP | 0.003 |
| 19 | PFSCLSLPS | 0.001 |
| 28 | SWDYRCPPP | 0.000 |

TABLE XX

V5A-HLA-B3501-
9mers-98P4B6
Each peptide is a portion of
SEQ ID NO: 11; each start
position is specified, the
length of peptide is 9 amino
acids, and the end position
for each peptide is the start
position plus eight.

| Start | Subsequence | Score |
|---|---|---|
| 2 | LPLRLFTFW | 10.000 |
| 1 | NLPLRLFTF | 1.000 |
| 7 | FTFWRGPVV | 0.200 |
| 9 | FWRGPVVVA | 0.030 |
| 6 | LFTFWRGPV | 0.020 |
| 5 | RLFTFWRGP | 0.020 |
| 8 | TFWRGPVVV | 0.020 |
| 3 | PLRLFTFWR | 0.003 |
| 4 | LRLFTFWRG | 0.001 |

TABLE XX

V5B-HLA-B3501-
9mers-98P4B6
Each peptide is a portion of
SEQ ID NO: 11; each start
position is specified, the
length of peptide is 9 amino
acids, and the end position
for each peptide is the start
position plus eight.

| Start | Subsequence | Score |
|---|---|---|
| 16 | TQTELELEF | 2.000 |
| 24 | FVFLLTLLL | 1.000 |
| 4 | FSFIQIFCS | 0.500 |
| 19 | ELELEFVFL | 0.450 |
| 12 | SFADTQTEL | 0.200 |

TABLE XX-continued

V5B-HLA-B3501-
9mers-98P4B6
Each peptide is a portion of
SEQ ID NO: 11; each start
position is specified, the
length of peptide is 9 amino
acids, and the end position
for each peptide is the start
position plus eight.

| Start | Subsequence | Score |
|---|---|---|
| 18 | TELELEFVF | 0.200 |
| 20 | LELEFVFLL | 0.200 |
| 2 | REFSFIQIF | 0.200 |
| 22 | LEFVFLLTL | 0.100 |
| 10 | FCSFADTQT | 0.100 |
| 8 | QIFCSFADT | 0.100 |
| 23 | EFVFLLTLL | 0.100 |
| 6 | FIQIFCSFA | 0.100 |
| 14 | ADTQTELEL | 0.100 |
| 5 | SFIQIFCSF | 0.100 |
| 17 | QTELELEFV | 0.090 |
| 11 | CSFADTQTE | 0.075 |
| 21 | ELEFVFLLT | 0.030 |
| 15 | DTQTELELE | 0.015 |
| 1 | WREFSFIQI | 0.012 |
| 7 | IQIFCSFAD | 0.010 |
| 3 | EFSFIQIFC | 0.010 |
| 13 | FADTQTELE | 0.009 |
| 9 | IFCSFADTQ | 0.001 |

TABLE XX

V6-HLA-B3501-
9mers-98P4B6
Each peptide is a portion of
SEQ ID NO: 13; each start
position is specified, the
length of peptide is 9 amino
acids, and the end position
for each peptide is the start
position plus eight.

| Start | Subsequence | Score |
|---|---|---|
| 46 | VSPERVTVM | 20.000 |
| 27 | KGWEKSQFL | 4.000 |
| 43 | IPHVSPERV | 4.000 |
| 31 | KSQFLEEGI | 4.000 |
| 21 | KLKRIKKGW | 3.000 |
| 14 | FLPCISRKL | 1.000 |

TABLE XX-continued

V6-HLA-B3501-
9mers-98P4B6
Each peptide is a portion of
SEQ ID NO: 13; each start
position is specified, the
length of peptide is 9 amino
acids, and the end position
for each peptide is the start
position plus eight.

| Start | Subsequence | Score |
|---|---|---|
| 6 | VILGKIILF | 1.000 |
| 5 | IVILGKIIL | 1.000 |
| 7 | ILGKIILFL | 1.000 |
| 10 | KIILFLPCI | 0.800 |
| 24 | RIKKGWEKS | 0.600 |
| 17 | CISRKLKRI | 0.400 |
| 4 | SIVILGKII | 0.400 |
| 45 | HVSPERVTV | 0.300 |
| 26 | KKGWEKSQF | 0.300 |
| 2 | LPSIVILGK | 0.200 |
| 15 | LPCISRKLK | 0.200 |
| 38 | GIGGTIPHV | 0.200 |
| 3 | PSIVILGKI | 0.200 |
| 18 | ISRKLKRIK | 0.150 |
| 39 | IGGTIPHVS | 0.100 |
| 11 | IILFLPCIS | 0.100 |
| 34 | FLEEGIGGT | 0.060 |
| 8 | LGKIILFLP | 0.030 |
| 32 | SQFLEEGIG | 0.015 |
| 35 | LEEGIGGTI | 0.012 |
| 37 | EGIGGTIPH | 0.010 |
| 41 | GTIPHVSPE | 0.010 |
| 40 | GGTIPHVSP | 0.010 |
| 1 | VLPSIVILG | 0.010 |
| 9 | GKIILFLPC | 0.010 |
| 12 | ILFLPCISR | 0.010 |
| 42 | TIPHVSPER | 0.010 |
| 33 | QFLEEGIGG | 0.003 |
| 29 | WEKSQFLEE | 0.003 |
| 25 | IKKGWEKSQ | 0.003 |
| 22 | LKRIKKGWE | 0.003 |
| 19 | SRKLKRIKK | 0.003 |
| 20 | RKLKRIKKG | 0.002 |

TABLE XX-continued

V6-HLA-B3501-
9mers-98P4B6
Each peptide is a portion of
SEQ ID NO: 13; each start
position is specified, the
length of peptide is 9 amino
acids, and the end position
for each peptide is the start
position plus eight.

| Start | Subsequence | Score |
|---|---|---|
| 23 | KRIKKGWEK | 0.002 |
| 44 | PHVSPERVT | 0.001 |
| 13 | LFLPCISRK | 0.001 |
| 30 | EKSQFLEEG | 0.001 |
| 16 | PCISRKLKR | 0.001 |
| 36 | EEGIGGTIP | 0.001 |
| 28 | GWEKSQFLE | 0.000 |

TABLE XX

V7A-HLA-B3501-
9mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 1 | SPKSLSETF | 60.000 |
| 9 | FLPNGINGI | 0.400 |
| 4 | SLSETFLPN | 0.200 |
| 3 | KSLSETFLP | 0.150 |
| 7 | ETFLPNGIN | 0.100 |
| 6 | SETFLPNGI | 0.040 |
| 5 | LSETFLPNG | 0.015 |
| 2 | PKSLSETFL | 0.010 |
| 8 | TFLPNGING | 0.001 |

TABLE XX

V7B-HLA-B3501-
9mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 8 | QSTLGYVAL | 5.000 |
| 9 | STLGYVALL | 1.000 |

TABLE XX-continued

V7B-HLA-B3501-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 3 | NMAYQQSTL | 1.000 |
| 6 | YQQSTLGYV | 0.200 |
| 5 | AYQQSTLGY | 0.200 |
| 7 | QQSTLGYVA | 0.100 |
| 1 | FLNMAYQQS | 0.100 |
| 2 | LNMAYQQST | 0.100 |
| 4 | MAYQQSTLG | 0.030 |

TABLE XX

V7C-HLA-B3501-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 181 | KSKHCMFSL | 30.000 |
| 15 | SPAAAWKCL | 20.000 |
| 139 | KSQAASGTL | 10.000 |
| 50 | LSTPPPPAM | 10.000 |
| 152 | TSWSLGEFL | 5.000 |
| 143 | ASGTLSLAF | 5.000 |
| 165 | WMKLETIIL | 4.500 |
| 101 | DPPESPDRA | 4.000 |
| 179 | EQKSKHCMF | 3.000 |
| 24 | GANILRGGL | 3.000 |
| 141 | QAASGTLSL | 3.000 |
| 108 | RALKAANSW | 3.000 |
| 29 | RGGLSEIVL | 2.000 |
| 52 | TPPPPAMWT | 2.000 |
| 27 | ILRGGLSEI | 1.200 |
| 78 | SSSSSQIPV | 1.000 |
| 126 | GVGPLWEFL | 1.000 |
| 113 | ANSWRNPVL | 1.000 |

TABLE XX-continued

V7C-HLA-B3501-9mers-98P4B6
Each peptide is a portion of SEQ ID NO: 15; each start position is specified, the length of peptide is 9 amino acids, and the end position for each peptide is the start position plus eight.

| Start | Subsequence | Score |
|---|---|---|
| 104 | ESPDRALKA | 1.000 |
| 160 | LGSGTWMKL | 1.000 |
| 127 | VGPLWEFLL | 1.000 |
| 79 | SSSSQIPVV | 1.000 |
| 148 | SLAFTSWSL | 1.000 |
| 151 | FTSWSLGEF | 1.000 |
| 125 | NGVGPLWEF | 1.000 |
| 81 | SSQIPVVGV | 1.000 |
| 31 | GLSEIVLPI | 0.800 |
| 154 | WSLGEFLGS | 0.750 |
| 102 | PPESPDRAL | 0.600 |
| 112 | AANSWRNPV | 0.600 |
| 105 | SPDRALKAA | 0.600 |
| 68 | EAQESGIRN | 0.600 |
| 51 | STPPPPAMW | 0.500 |
| 147 | LSLAFTSWS | 0.500 |
| 146 | TLSLAFTSW | 0.500 |
| 12 | VLASPAAAW | 0.500 |
| 71 | ESGIRNKSS | 0.500 |
| 123 | HTNGVGPLW | 0.500 |
| 14 | ASPAAAWKC | 0.500 |
| 64 | GATAEAQES | 0.450 |
| 163 | GTWMKLETI | 0.400 |
| 37 | LPIEWQQDR | 0.400 |
| 4 | VILDLSVEV | 0.400 |
| 66 | TAEAQESGI | 0.360 |
| 134 | LLRLLKSQA | 0.300 |
| 42 | QQDRKIPPL | 0.300 |
| 73 | GIRNKSSSS | 0.300 |
| 17 | AAAWKCLGA | 0.300 |
| 142 | AASGTLSLA | 0.300 |
| 128 | GPLWEFLLR | 0.300 |
| 18 | AAWKCLGAN | 0.300 |

TABLE XX-continued

V7C-HLA-B3501-
9mers-98P4B6
Each peptide is a portion of
SEQ ID NO: 15; each start
position is specified, the
length of peptide is 9 amino
acids, and the end position
for each peptide is the start
position plus eight.

| Start | Subsequence | Score |
|---|---|---|
| 5 | ILDLSVEVL | 0.300 |
| 136 | RLLKSQAAS | 0.200 |
| 82 | SQIPVVGVV | 0.200 |
| 47 | IPPLSTPPP | 0.200 |
| 55 | PPAMWTEEA | 0.200 |
| 121 | LPHTNGVGP | 0.200 |
| 129 | PLWEFLLRL | 0.200 |
| 178 | QEQKSKHCM | 0.200 |
| 117 | RNPVLPHTN | 0.200 |
| 2 | SIVILDLSV | 0.200 |
| 158 | EFLGSGTWM | 0.200 |
| 84 | IPVVGVVTE | 0.200 |
| 118 | NPVLPHTNG | 0.200 |
| 57 | AMWTEEAGA | 0.150 |
| 173 | LSKLTQEQK | 0.150 |
| 7 | DLSVEVLAS | 0.150 |
| 88 | GVVTEDDEA | 0.150 |
| 19 | AWKCLGANI | 0.120 |
| 98 | DSIDPPESP | 0.100 |
| 145 | GTLSLAFTS | 0.100 |
| 83 | QIPVVGVVT | 0.100 |
| 8 | LSVEVLASP | 0.100 |
| 168 | LETIILSKL | 0.100 |
| 169 | ETIILSKLT | 0.100 |
| 162 | SGTWMKLET | 0.100 |
| 11 | EVLASPAAA | 0.100 |
| 25 | ANILRGGLS | 0.100 |
| 72 | SGIRNKSSS | 0.100 |
| 144 | SGTLSLAFT | 0.100 |
| 140 | SQAASGTLS | 0.100 |
| 77 | KSSSSQIP | 0.100 |
| 185 | CMFSLISGS | 0.100 |
| 20 | WKCLGANIL | 0.100 |
| 95 | EAQDSIDPP | 0.060 |
| 111 | KAANSWRNP | 0.060 |
| 75 | RNKSSSSSQ | 0.060 |
| 59 | WTEEAGATA | 0.060 |
| 1 | PSIVILDLS | 0.050 |
| 80 | SSSQIPVVG | 0.050 |
| 157 | GEFLGSGTW | 0.050 |
| 33 | SEIVLPIEW | 0.050 |
| 161 | GSGTWMKLE | 0.050 |
| 114 | NSWRNPVLP | 0.050 |
| 76 | NKSSSSSQI | 0.040 |
| 164 | TWMKLETII | 0.040 |
| 182 | SKHCMFSLI | 0.040 |
| 39 | IEWQQDRKI | 0.040 |
| 58 | MWTEEAGAT | 0.030 |
| 89 | VVTEDDEAQ | 0.030 |

TABLE XXI

V1-HLA-B3501-
10mers-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 157 | GPKDASRQVY | 240.000 |
| 9 | SPKSLSETCL | 60.000 |
| 250 | IPIEIVNKTL | 40.000 |
| 197 | SAREIENLPL | 27.000 |
| 323 | LPMRRSERYL | 20.000 |
| 438 | LPSIVILDLL | 20.000 |
| 239 | YARNQQSDFY | 18.000 |
| 417 | RAFEEEYYRF | 18.000 |
| 379 | IPSVSNALNW | 10.000 |
| 116 | VSNNMRINQY | 10.000 |

TABLE XXI-continued

V1-HLA-B3501-
10mers-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 391 | FSFIQSTLGY | 10.000 |
| 220 | ISLATFFFLY | 10.000 |
| 195 | LSSAREIENL | 7.500 |
| 137 | FPDSLIVKGF | 6.000 |
| 327 | RSERYLFLNM | 6.000 |
| 262 | VAITLLSLVY | 6.000 |
| 361 | ISFGIMSLGL | 5.000 |
| 395 | QSTLGYVALL | 5.000 |
| 267 | LSLVYLAGLL | 5.000 |
| 99 | TSLWDLRHLL | 5.000 |
| 127 | ESNAEYLASL | 5.000 |
| 4 | ISMMGSPKSL | 5.000 |
| 382 | VSNALNWREF | 5.000 |
| 377 | TSIPSVSNAL | 5.000 |
| 428 | TPPNFVLALV | 4.000 |
| 188 | IPIDLGSLSS | 4.000 |
| 111 | KILIDVSNNM | 4.000 |
| 181 | LARQLNFIPI | 3.600 |
| 27 | DARKVTVGVI | 3.600 |
| 41 | FAKSLTIRLI | 3.600 |
| 384 | NALNWREFSF | 3.000 |
| 312 | FAMVHVAYSL | 3.000 |
| 222 | LATFFFLYSF | 3.000 |
| 81 | DALTKTNIIF | 3.000 |
| 218 | VAISLATFFF | 3.000 |
| 322 | CLPMRRSERY | 2.000 |
| 429 | PPNFVLALVL | 2.000 |
| 316 | HVAYSLCLPM | 2.000 |
| 61 | RNPKFASEFF | 2.000 |
| 257 | KTLPIVAITL | 2.000 |
| 259 | LPIVAITLLS | 2.000 |
| 45 | LTIRLIRCGY | 2.000 |
| 275 | LLAAAYQLYY | 2.000 |

TABLE XXI-continued

V1-HLA-B3501-
10mers-98P4B6
Each peptide is a portion of
SEQ ID NO: 3; each start
position is specified, the
length of peptide is 10 amino
acids, and the end position
for each peptide is the start
position plus nine.

| Start | Subsequence | Score |
|---|---|---|
| 274 | GLLAAAYQLY | 2.000 |
| 303 | KQLGLLSFFF | 2.000 |
| 128 | SNAEYLASLF | 2.000 |
| 123 | NQYPESNAEY | 2.000 |
| 305 | LGLLSFFFAM | 2.000 |
| 404 | LISTFHVLIY | 2.000 |
| 213 | RGPVVVAISL | 2.000 |
| 271 | YLAGLLAAAY | 2.000 |
| 183 | RQLNFIPIDL | 2.000 |
| 214 | GPVVVAISLA | 2.000 |
| 134 | ASLFPDSLIV | 1.500 |
| 440 | SIVILDLLQL | 1.500 |
| 98 | YTSLWDLRHL | 1.500 |
| 161 | ASRQVYICSN | 1.500 |
| 285 | GTKYRRFPPW | 1.500 |
| 103 | DLRHLLVGKI | 1.200 |
| 336 | MAYQQVHANI | 1.200 |
| 255 | VNKTLPIVAI | 1.200 |
| 65 | FASEFFPHVV | 1.200 |
| 49 | LIRCGYHVVI | 1.200 |
| 434 | LALVLPSIVI | 1.200 |
| 133 | LASLFPDSLI | 1.200 |
| 24 | GIKDARKVTV | 1.200 |
| 241 | RNQQSDFYKI | 1.200 |
| 32 | TVGVIGSGDF | 1.000 |
| 435 | ALVLPSIVIL | 1.000 |
| 273 | AGLLAAAYQL | 1.000 |
| 36 | IGSGDFAKSL | 1.000 |
| 308 | LSFFFAMVHV | 1.000 |
| 56 | VVIGSRNPKF | 1.000 |
| 176 | QQVIELARQL | 1.000 |
| 296 | ETWLQCRKQL | 1.000 |
| 43 | KSLTIRLIRC | 1.000 |
| 202 | ENLPLRLFTL | 1.000 |

TABLE XXI-continued

V1-HLA-B3501-10mers-98P4B6
Each peptide is a portion of SEQ ID NO: 3; each start position is specified, the length of peptide is 10 amino acids, and the end position for each peptide is the start position plus nine.

| Start | Subsequence | Score |
|---|---|---|
| 147 | NVVSAWALQL | 1.000 |
| 217 | VVAISLATFF | 1.000 |
| 216 | VVVAISLATF | 1.000 |
| 132 | YLASLFPDSL | 1.000 |
| 364 | GIMSLGLLSL | 1.000 |
| 365 | IMSLGLLSLL | 1.000 |
| 92 | AIHREHYTSL | 1.000 |
| 314 | MVHVAYSLCL | 1.000 |
| 410 | VLIYGWKRAF | 1.000 |
| 299 | LQCRKQLGLL | 1.000 |
| 394 | IQSTLGYVAL | 1.000 |
| 11 | KSLSETCLPN | 1.000 |
| 263 | AITLLSLVYL | 1.000 |
| 172 | IQARQQVIEL | 1.000 |
| 219 | AISLATFFFL | 1.000 |
| 298 | WLQCRKQLGL | 1.000 |
| 37 | GSGDFAKSLT | 1.000 |
| 402 | ALLISTFHVL | 1.000 |
| 258 | TLPIVAITLL | 1.000 |
| 427 | YTPPNFVLAL | 1.000 |
| 139 | DSLIVKGFNV | 1.000 |
| 437 | VLPSIVILDL | 1.000 |
| 266 | LLSLVYLAGL | 1.000 |

TABLE XXI

V2-HLA-B3501-10mers-98P4B6
Each peptide is a portion of SEQ ID NO: 5; each start position is specified, the length of peptide is 10 amino acids, and the end position for each peptide is the start position plus nine.

| Start | Subsequence | Score |
|---|---|---|
| 33 | CPPPCPADFF | 20.000 |
| 35 | PPCPADFFLY | 6.000 |
| 14 | SSGFTPFSCL | 5.000 |
| 11 | LSLSSGFTPF | 5.000 |
| 2 | GSPGLQALSL | 5.000 |
| 20 | FSCLSLPSSW | 2.500 |
| 34 | PPCPADFFL | 2.000 |
| 3 | SPGLQALSLS | 2.000 |
| 22 | CLSLPSSWDY | 2.000 |
| 32 | RCPPPCPADF | 2.000 |
| 18 | TPFSCLSLPS | 2.000 |
| 8 | ALSLSLSSGF | 1.000 |
| 9 | LSLSLSSGFT | 0.500 |
| 13 | LSSGFTPFSC | 0.500 |
| 25 | LPSSWDYRCP | 0.300 |
| 4 | PGLQALSLSL | 0.100 |
| 15 | SGFTPFSCLS | 0.100 |
| 27 | SSWDYRCPPP | 0.100 |
| 16 | GFTPFSCLSL | 0.100 |
| 6 | LQALSLSLSS | 0.100 |
| 1 | SGSPGLQALS | 0.100 |
| 24 | SLPSSWDYRC | 0.100 |
| 36 | PCPADFFLYF | 0.100 |
| 5 | GLQALSLSLS | 0.100 |
| 12 | SLSSGFTPFS | 0.100 |
| 23 | LSLPSSWDYR | 0.050 |
| 7 | QALSLSLSSG | 0.030 |
| 30 | DYRCPPPCPA | 0.030 |
| 17 | FTPFSCLSLP | 0.010 |
| 10 | SLSLSSGFTP | 0.010 |
| 21 | SCLSLPSSWD | 0.010 |
| 26 | PSSWDYRCPP | 0.005 |
| 28 | SWDYRCPPPC | 0.003 |
| 29 | WDYRCPPPCP | 0.001 |

TABLE XXI-continued

V2-HLA-B3501-
10mers-98P4B6
Each peptide is a portion of
SEQ ID NO: 5; each start
position is specified, the
length of peptide is 10 amino
acids, and the end position
for each peptide is the start
position plus nine.

| Start | Subsequence | Score |
|---|---|---|
| 19 | PFSCLSLPSS | 0.001 |
| 31 | YRCPPPCPAD | 0.001 |

TABLE XXI

V5A-HLA-B3501-
10mers-98P4B6
Each peptide is a portion of
SEQ ID NO: 11; each start
position is specified, the
length of peptide is 10 amino
acids, and the end position
for each peptide is the start
position plus nine.

| Start | Subsequence | Score |
|---|---|---|
| 1 | ENLPLRLFTF | 1.000 |
| 2 | NLPLRLFTFW | 0.500 |
| 6 | RLFTFWRGPV | 0.400 |
| 8 | FTFWRGPVVV | 0.200 |
| 3 | LPLRLFTFWR | 0.200 |
| 10 | FWRGPVVVAI | 0.120 |
| 7 | LFTFWRGPVV | 0.020 |
| 9 | TFWRGPVVVA | 0.010 |
| 4 | PLRLFTFWRG | 0.003 |
| 5 | LRLFTFWRGP | 0.001 |

TABLE XXI

V5B-HLA-3501-
10mers-98P4B6
Each peptide is a portion of
SEQ ID NO: 11; each start
position is specified, the
length of peptide is 10 amino
acids, and the end position
for each peptide is the start
position plus nine.

| Start | Subsequence | Score |
|---|---|---|
| 12 | CSFADTQTEL | 5.000 |
| 5 | FSFIQIFCSF | 5.000 |
| 16 | DTQTELELEF | 1.000 |
| 14 | FADTQTELEL | 0.900 |
| 17 | TQTELELEFV | 0.600 |

TABLE XXI-continued

V5B-HLA-3501-
10mers-98P4B6
Each peptide is a portion of
SEQ ID NO: 11; each start
position is specified, the
length of peptide is 10 amino
acids, and the end position
for each peptide is the start
position plus nine.

| Start | Subsequence | Score |
|---|---|---|
| 22 | ELEFVFLLTL | 0.300 |
| 18 | QTELELEFVF | 0.300 |
| 20 | ELELEFVFLL | 0.300 |
| 19 | TELELEFVFL | 0.300 |
| 1 | NWREFSFIQI | 0.240 |
| 8 | IQIFCSFADT | 0.100 |
| 23 | LEFVFLLTLL | 0.100 |
| 24 | EFVFLLTLLL | 0.100 |
| 2 | WREFSFIQIF | 0.030 |
| 3 | REFSFIQIFC | 0.020 |
| 21 | LELEFVFLLT | 0.020 |
| 11 | FCSFADTQTE | 0.015 |
| 10 | IFCSFADTQT | 0.010 |
| 7 | FIQIFCSFAD | 0.010 |
| 4 | EFSFIQIFCS | 0.010 |
| 9 | QIFCSFADTQ | 0.010 |
| 6 | SFIQIFCSFA | 0.010 |
| 13 | SFADTQTELE | 0.002 |
| 15 | ADTQTELELE | 0.002 |

TABLE XXI

V6-HLA-B3501-
10mers-98P4B6
Each peptide is a portion of
SEQ ID NO: 13; each start
position is specified, the
length of peptide is 10 amino
acids, and the end position
for each peptide is the start
position plus nine.

| Start | Subsequence | Score |
|---|---|---|
| 3 | LPSIVILGKI | 8.000 |
| 44 | IPHVSPERVT | 2.000 |
| 46 | HVSPERVTVM | 2.000 |
| 6 | IVILGKIILF | 1.000 |
| 7 | VILGKIILFL | 1.000 |
| 5 | SIVILGKIIL | 1.000 |

TABLE XXI-continued

V6-HLA-B3501-
10mers-98P4B6
Each peptide is a portion of
SEQ ID NO: 13; each start
position is specified, the
length of peptide is 10 amino
acids, and the end position
for each peptide is the start
position plus nine.

| Start | Subsequence | Score |
|---|---|---|
| 26 | IKKGWEKSQF | 0.450 |
| 9 | LGKIILFLPC | 0.300 |
| 35 | FLEEGIGGTI | 0.240 |
| 43 | TIPHVSPERV | 0.200 |
| 11 | KIILFLPCIS | 0.200 |
| 27 | KKGWEKSQFL | 0.200 |
| 38 | EGIGGTIPHV | 0.200 |
| 16 | LPCISRKLKR | 0.200 |
| 4 | PSIVILGKII | 0.200 |
| 32 | KSQFLEEGIG | 0.150 |
| 19 | ISRKLKRIKK | 0.150 |
| 39 | GIGGTIPHVS | 0.100 |
| 14 | LFLPCISRKL | 0.100 |
| 21 | RKLKRIKKGW | 0.100 |
| 25 | RIKKGWEKSQ | 0.060 |
| 22 | KLKRIKKGWE | 0.060 |
| 10 | GKIILFLPCI | 0.040 |
| 28 | KGWEKSQFLE | 0.040 |
| 17 | PCISRKLKRI | 0.040 |
| 31 | EKSQFLEEGI | 0.040 |
| 24 | KRIKKGWEKS | 0.020 |
| 34 | QFLEEGIGGT | 0.020 |
| 33 | SQFLEEGIGG | 0.015 |
| 13 | ILFLPCISRK | 0.010 |
| 18 | CISRKLKRIK | 0.010 |
| 8 | ILGKIILFLP | 0.010 |
| 2 | VLPSIVILGK | 0.010 |
| 40 | IGGTIPHVSP | 0.010 |
| 15 | FLPCISRKLK | 0.010 |
| 41 | GGTIPHVSPE | 0.010 |
| 1 | LVLPSIVILG | 0.010 |
| 42 | GTIPHVSPER | 0.010 |
| 12 | IILFLPCISR | 0.010 |

TABLE XXI-continued

V6-HLA-B3501-
10mers-98P4B6
Each peptide is a portion of
SEQ ID NO: 13; each start
position is specified, the
length of peptide is 10 amino
acids, and the end position
for each peptide is the start
position plus nine.

| Start | Subsequence | Score |
|---|---|---|
| 45 | PHVSPERVTV | 0.003 |
| 20 | SRKLKRIKKG | 0.003 |
| 30 | WEKSQFLEEG | 0.003 |
| 23 | LKRIKKGWEK | 0.003 |
| 37 | EEGIGGTIPH | 0.001 |
| 36 | LEEGIGGTIP | 0.000 |
| 29 | GWEKSQFLEE | 0.000 |

TABLE XXI

V7A-HLA-3501-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 2 | SPKSLSETFL | 60.000 |
| 1 | GSPKSLSETF | 5.000 |
| 4 | KSLSETFLPN | 1.000 |
| 6 | LSETFLPNGI | 0.600 |
| 9 | TFLPNGINGI | 0.040 |
| 5 | SLSETFLPNG | 0.020 |
| 10 | FLPNGINGIK | 0.010 |
| 7 | SETFLPNGIN | 0.010 |
| 8 | ETFLPNGING | 0.010 |
| 3 | PKSLSETFLP | 0.000 |

TABLE XXI

V7B-HLA-B3501-10mers-98P4B6
Each peptide is a portion of SEQ ID NO: 15; each start position is specified, the length of peptide is 10 amino acids, and the end position for each peptide is the start position plus nine.

| Start | Subsequence | Score |
|---|---|---|
| 5 | MAYQQSTLGY | 6.000 |
| 9 | QSTLGYVALL | 5.000 |
| 3 | LNMAYQQSTL | 1.000 |
| 8 | QQSTLGYVAL | 1.000 |
| 10 | STLGYVALLI | 0.400 |
| 7 | YQQSTLGYVA | 0.100 |
| 2 | FLNMAYQQST | 0.100 |
| 6 | AYQQSTLGYV | 0.020 |
| 4 | NMAYQQSTLG | 0.010 |
| 1 | LFLNMAYQQS | 0.010 |

TABLE XXI

V7C-HLA-B3501-10mers-98P4B6
Each peptide is a portion of SEQ ID NO: 15; each start position is specified, the length of peptide is 10 amino acids, and the end position for each peptide is the start position plus nine.

| Start | Subsequence | Score |
|---|---|---|
| 100 | SIDPPESPDR | 100.000 |
| 67 | TAEAQESGIR | 9.000 |
| 33 | LSEIVLPIEW | 6.750 |
| 131 | LWEFLLRLLK | 4.500 |
| 91 | VTEDDEAQDS | 2.250 |
| 10 | SVEVLASPAA | 1.800 |
| 52 | STPPPPAMWT | 1.250 |
| 6 | ILDLSVEVLA | 1.000 |
| 168 | KLETIILSKL | 0.900 |
| 103 | PPESPDRALK | 0.900 |
| 127 | GVGPLWEFLL | 0.500 |
| 143 | AASGTLSLAF | 0.500 |
| 13 | VLASPAAAWK | 0.400 |
| 51 | LSTPPPPAMW | 0.300 |
| 60 | WTEEAGATAE | 0.225 |
| 157 | LGEFLGSGTW | 0.225 |
| 69 | EAQESGIRNK | 0.200 |
| 97 | AQDSIDPPES | 0.150 |
| 70 | AQESGIRNKS | 0.135 |
| 178 | TQEQKSKHCM | 0.135 |
| 170 | ETIILSKLTQ | 0.125 |
| 128 | VGPLWEFLLR | 0.125 |
| 37 | VLPIEWQQDR | 0.100 |
| 14 | LASPAAAWKC | 0.100 |
| 61 | TEEAGATAEA | 0.090 |
| 39 | PIEWQQDRKI | 0.090 |
| 162 | GSGTWMKLET | 0.075 |
| 78 | KSSSSSQIPV | 0.075 |
| 160 | FLGSGTWMKL | 0.050 |
| 22 | KCLGANILRG | 0.050 |
| 167 | MKLETIILSK | 0.050 |
| 38 | LPIEWQQDRK | 0.050 |
| 80 | SSSSQIPVVG | 0.030 |
| 79 | SSSSSQIPVV | 0.030 |
| 83 | SQIPVVGVVT | 0.030 |
| 144 | ASGTLSLAFT | 0.030 |
| 81 | SSSQIPVVGV | 0.030 |
| 146 | GTLSLAFTSW | 0.025 |
| 66 | ATAEAQESGI | 0.025 |
| 152 | FTSWSLGEFL | 0.025 |
| 125 | TNGVGPLWEF | 0.025 |
| 92 | TEDDEAQDSI | 0.025 |
| 177 | LTQEQKSKHC | 0.025 |
| 21 | WKCLGANILR | 0.025 |
| 106 | SPDRALKAAN | 0.025 |
| 94 | DDEAQDSIDP | 0.022 |
| 12 | EVLASPAAAW | 0.020 |
| 4 | IVILDLSVEV | 0.020 |
| 173 | ILSKLTQEQK | 0.020 |

TABLE XXI-continued

V7C-HLA-B3501-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 47 | KIPPLSTPPP | 0.020 |
| 113 | AANSWRNPVL | 0.020 |
| 72 | ESGIRNKSSS | 0.015 |
| 43 | QQDRKIPPLS | 0.015 |
| 15 | ASPAAAWKCL | 0.015 |
| 140 | KSQAASGTLS | 0.015 |
| 9 | LSVEVLASPA | 0.015 |
| 82 | SSQIPVVGVV | 0.015 |
| 155 | WSLGEFLGSG | 0.015 |
| 105 | ESPDRALKAA | 0.015 |
| 148 | LSLAFTSWSL | 0.015 |
| 124 | HTNGVGPLWE | 0.013 |
| 129 | GPLWEFLLRL | 0.013 |
| 31 | GGLSEIVLPI | 0.013 |
| 145 | SGTLSLAFTS | 0.013 |
| 185 | HCMFSLISGS | 0.010 |
| 149 | SLAFTSWSLG | 0.010 |
| 65 | GATAEAQESG | 0.010 |
| 112 | KAANSWRNPV | 0.010 |
| 142 | QAASGTLSLA | 0.010 |
| 25 | GANILRGGLS | 0.010 |
| 159 | EFLGSGTWMK | 0.010 |
| 23 | CLGANILRGG | 0.010 |
| 109 | RALKAANSWR | 0.010 |
| 176 | KLTQEQKSKH | 0.010 |
| 35 | EIVLPIEWQQ | 0.010 |
| 175 | SKLTQEQKSK | 0.010 |
| 18 | AAAWKCLGAN | 0.010 |
| 36 | IVLPIEWQQD | 0.010 |
| 5 | VILDLSVEVL | 0.010 |
| 172 | IILSKLTQEQ | 0.010 |
| 156 | SLGEFLGSGT | 0.010 |
| 120 | PVLPHTNGVG | 0.010 |

TABLE XXI-continued

V7C-HLA-B3501-
10mers-98P4B6
Each peptide is a portion of
SEQ ID NO: 15; each start
position is specified, the
length of peptide is 10 amino
acids, and the end position
for each peptide is the start
position plus nine.

| Start | Subsequence | Score |
|---|---|---|
| 147 | TLSLAFTSWS | 0.010 |
| 89 | GVVTEDDEAQ | 0.010 |
| 153 | TSWSLGEFLG | 0.008 |
| 2 | PSIVILDLSV | 0.008 |
| 141 | SQAASGTLSL | 0.007 |
| 150 | LAFTSWSLGE | 0.005 |
| 17 | PAAAWKCLGA | 0.005 |
| 101 | IDPPESPDRA | 0.005 |
| 151 | AFTSWSLGEF | 0.005 |
| 117 | WRNPVLPHTN | 0.005 |
| 42 | WQQDRKIPPL | 0.003 |
| 104 | PESPDRALKA | 0.003 |
| 24 | LGANILRGGL | 0.003 |
| 119 | NPVLPHTNGV | 0.003 |
| 118 | RNPVLPHTNG | 0.003 |
| 102 | DPPESPDRAL | 0.003 |
| 53 | TPPPPAMWTE | 0.003 |
| 1 | LPSIVILDLS | 0.003 |

TABLE VIII

V8-HLA-A1-
9mers-98P4B6
Each peptide is a portion of
SEQ ID NO: 17; each start
position is specified, the
length of peptide is 9 amino
acids, and the end position
for each peptide is the start
position plus eight.

| Start | Subsequence | Score |
|---|---|---|
| 4 | FLEEGMGGT | 0.900 |
| 5 | LEEGMGGTI | 0.045 |
| 1 | KSQFLEEGM | 0.015 |
| 7 | EGMGGTIPH | 0.013 |
| 8 | GMGGTIPHV | 0.010 |
| 9 | MGGTIPHVS | 0.003 |
| 3 | QFLEEGMGG | 0.003 |

TABLE VIII-continued

V8-HLA-A1-9mers-98P4B6
Each peptide is a portion of SEQ ID NO: 17; each start position is specified, the length of peptide is 9 amino acids, and the end position for each peptide is the start position plus eight.

| Start | Subsequence | Score |
|---|---|---|
| 2 | SQFLEEGMG | 0.002 |
| 6 | EEGMGGTIP | 0.000 |

TABLE VIII

V13-HLA-A1-9mers-98P4B6
Each peptide is a portion of SEQ ID NO: 27; each start position is specified, the length of peptide is 9 amino acids, and the end position for each peptide is the start position plus eight.

| Start | Subsequence | Score |
|---|---|---|
| 5 | LSETFLPNG | 2.700 |
| 4 | SLSETFLPN | 0.050 |
| 7 | ETFLPNGIN | 0.025 |
| 8 | TFLPNGING | 0.025 |
| 9 | FLPNGINGI | 0.010 |
| 3 | KSLSETFLP | 0.007 |
| 1 | SPKSLSETF | 0.003 |
| 6 | SETFLPNGI | 0.001 |
| 2 | PKSLSETFL | 0.000 |

TABLE VIII

V14-HLA-A1-9mers-98P4B6
Each peptide is a portion of SEQ ID NO: 29; each start position is specified, the length of peptide is 9 amino acids, and the end position for each peptide is the start position plus eight.

| Start | Subsequence | Score |
|---|---|---|
| 1 | NLPLRLFTF | 0.500 |
| 7 | FTFWRGPVV | 0.050 |
| 3 | PLRLFTFWR | 0.005 |
| 5 | RLFTFWRGP | 0.001 |
| 6 | LFTFWRGPV | 0.001 |
| 4 | LRLFTFWRG | 0.001 |

TABLE VIII-continued

V14-HLA-A1-9mers-98P4B6
Each peptide is a portion of SEQ ID NO: 29; each start position is specified, the length of peptide is 9 amino acids, and the end position for each peptide is the start position plus eight.

| Start | Subsequence | Score |
|---|---|---|
| 2 | LPLRLFTFW | 0.000 |
| 9 | FWRGPVVVA | 0.000 |
| 8 | TFWRGPVVV | 0.000 |

TABLE VIII

V21-HLA-A1-9mers-98P4B6
Each peptide is a portion of SEQ ID NO: 43; each start position is specified, the length of peptide is 9 amino acids, and the end position for each peptide is the start position plus eight.

| Start | Subsequence | Score |
|---|---|---|
| 2 | KLTQEQKTK | 0.200 |
| 4 | TQEQKTKHC | 0.135 |
| 3 | LTQEQKTKH | 0.025 |
| 8 | KTKHCMFSL | 0.013 |
| 6 | EQKTKHCMF | 0.002 |
| 9 | TKHCMFSLI | 0.001 |
| 1 | SKLTQEQKT | 0.001 |
| 7 | QKTKHCMFS | 0.000 |
| 5 | QEQKTKHCM | 0.000 |

TABLE VIII

V25-HLA-A1-9mers-98P4B6
Each peptide is a portion of SEQ ID NO: 51; each start position is specified, the length of peptide is 9 amino acids, and the end position for each peptide is the start position plus eight.

| Start | Subsequence | Score |
|---|---|---|
| 2 | LFLPCISQK | 0.100 |
| 1 | ILFLPCISQ | 0.050 |
| 5 | PCISQKLKR | 0.050 |
| 4 | LPCISQKLK | 0.050 |
| 7 | ISQKLKRIK | 0.030 |
| 8 | SQKLKRIKK | 0.015 |
| 3 | FLPCISQKL | 0.010 |

TABLE VIII-continued

V25-HLA-A1-9mers-98P4B6
Each peptide is a portion of SEQ ID NO: 51;
each start position is specified, the
length of peptide is 9 amino acids, and the
end position for each peptide is the start
position plus eight.

| Start | Subsequence | Score |
|---|---|---|
| 6 | CISQKLKRI | 0.010 |
| 9 | QKLKRIKKG | 0.000 |

TABLE IX

V8-HLA-A1-10mers-98P4B6
Each peptide is a portion of
SEQ ID NO: 17; each start
position is specified, the
length of peptide is 10 amino
acids, and the end position
for each peptide is the start
position plus nine.

| Start | Subsequence | Score |
|---|---|---|
| 5 | FLEEGMGGTI | 0.900 |
| 2 | KSQFLEEGMG | 0.015 |
| 3 | SQFLEEGMGG | 0.007 |
| 8 | EGMGGTIPHV | 0.005 |
| 9 | GMGGTIPHVS | 0.005 |
| 6 | LEEGMGGTIP | 0.005 |
| 7 | EEGMGGTIPH | 0.003 |
| 4 | QFLEEGMGGT | 0.001 |
| 10 | MGGTIPHVSP | 0.001 |
| 1 | EKSQFLEEGM | 0.001 |

TABLE IX

V13-HLA-A1-10mers-98P4B6
Each peptide is a portion of
SEQ ID NO: 27; each start
position is specified, the
length of peptide is 10 amino
acids, and the end position
for each peptide is the start
position plus nine.

| Start | Subsequence | Score |
|---|---|---|
| 6 | LSETFLPNGI | 1.350 |
| 10 | FLPNGINGIK | 0.200 |
| 8 | ETFLPNGING | 0.125 |
| 4 | KSLSETFLPN | 0.075 |
| 5 | SLSETFLPNG | 0.020 |
| 1 | GSPKSLSETF | 0.015 |

TABLE IX-continued

V13-HLA-A1-10mers-98P4B6
Each peptide is a portion of
SEQ ID NO: 27; each start
position is specified, the
length of peptide is 10 amino
acids, and the end position
for each peptide is the start
position plus nine.

| Start | Subsequence | Score |
|---|---|---|
| 9 | TFLPNGINGI | 0.005 |
| 7 | SETFLPNGIN | 0.001 |
| 2 | SPKSLSETFL | 0.000 |
| 3 | PKSLSETFLP | 0.000 |

TABLE IX

V14-HLA-A1-10mers-98P4B6
Each peptide is a portion of
SEQ ID NO: 29; each start
position is specified, the
length of peptide is 10 amino
acids, and the end position
for each peptide is the start
position plus nine.

| Start | Subsequence | Score |
|---|---|---|
| 1 | ENLPLRLFTF | 1.250 |
| 8 | FTFWRGPVVV | 0.050 |
| 3 | LPLRLFTFWR | 0.013 |
| 2 | NLPLRLFTFW | 0.010 |
| 6 | RLFTFWRGPV | 0.010 |
| 7 | LFTFWRGPVV | 0.001 |
| 4 | PLRLFTFWRG | 0.000 |
| 10 | FWRGPVVVAI | 0.000 |
| 5 | LRLFTFWRGP | 0.000 |
| 9 | TFWRGPVVVA | 0.000 |

TABLE IX

V21-HLA-A1-10mers-98P4B6
Each peptide is a portion of
SEQ ID NO: 43; each start
position is specified, the
length of peptide is 10 amino
acids, and the end position
for each peptide is the start
position plus nine.

| Start | Subsequence | Score |
|---|---|---|
| 5 | TQEQKTKHCM | 0.135 |
| 4 | LTQEQKTKHC | 0.025 |
| 3 | KLTQEQKTKH | 0.010 |

TABLE IX-continued

V21-HLA-A1-10mers-98P4B6
Each peptide is a portion of SEQ ID NO: 43; each start position is specified, the length of peptide is 10 amino acids, and the end position for each peptide is the start position plus nine.

| Start | Subsequence | Score |
|---|---|---|
| 2 | SKLTQEQKTK | 0.010 |
| 9 | KTKHCMFSLI | 0.003 |
| 10 | TKHCMFSLIS | 0.003 |
| 1 | LSKLTQEQKT | 0.002 |
| 7 | EQKTKHCMFS | 0.001 |
| 6 | QEQKTKHCMF | 0.001 |
| 8 | QKTKHCMFSL | 0.000 |

TABLE IX

V25-HLA-A1-10mers-98P4B6
Each peptide is a portion of SEQ ID NO: 51; each start position is specified, the length of peptide is 10 amino acids, and the end position for each peptide is the start position plus nine.

| Start | Subsequence | Score |
|---|---|---|
| 7 | CISQKLKRIK | 0.200 |
| 4 | FLPCISQKLK | 0.200 |
| 2 | ILFLPCISQK | 0.200 |
| 8 | ISQKLKRIKK | 0.150 |
| 5 | LPCISQKLKR | 0.125 |
| 1 | IILFLPCISQ | 0.050 |
| 3 | LFLPCISQKL | 0.005 |
| 6 | PCISQKLKRI | 0.001 |
| 9 | SQKLKRIKKG | 0.000 |
| 10 | QKLKRIKKGW | 0.000 |

TABLE X

V8-A0201-9mers-98P4B6
Each peptide is a portion of SEQ ID NO: 17; each start position is specified, the length of peptide is 9 amino acids, and the end position for each peptide is the start position plus eight.

| Start | Subsequence | Score |
|---|---|---|
| 8 | GMGGTIPHV | 115.534 |
| 4 | FLEEGMGGT | 2.689 |
| 1 | KSQFLEEGM | 0.056 |

TABLE X-continued

V8-A0201-9mers-98P4B6
Each peptide is a portion of SEQ ID NO: 17; each start position is specified, the length of peptide is 9 amino acids, and the end position for each peptide is the start position plus eight.

| Start | Subsequence | Score |
|---|---|---|
| 2 | SQFLEEGMG | 0.004 |
| 5 | LEEGMGGTI | 0.003 |
| 3 | QFLEEGMGG | 0.001 |
| 9 | MGGTIPHVS | 0.000 |
| 7 | EGMGGTIPH | 0.000 |
| 6 | EEGMGGTIP | 0.000 |

TABLE X

V13-A0201-9mers-98P4B6
Each peptide is a portion of SEQ ID NO: 27; each start position is specified, the length of peptide is 9 amino acids, and the end position for each peptide is the start position plus eight.

| Start | Subsequence | Score |
|---|---|---|
| 9 | FLPNGINGI | 110.379 |
| 4 | SLSETFLPN | 0.581 |
| 6 | SETFLPNGI | 0.203 |
| 3 | KSLSETFLP | 0.007 |
| 2 | PKSLSETFL | 0.004 |
| 5 | LSETFLPNG | 0.000 |
| 8 | TFLPNGING | 0.000 |
| 7 | ETFLPNGIN | 0.000 |
| 1 | SPKSLSETF | 0.000 |

TABLE X

V14-A0201-9mers-98P4B6
Each peptide is a portion of SEQ ID NO: 29; each start position is specified, the length of peptide is 9 amino acids, and the end position for each peptide is the start position plus eight.

| Start | Subsequence | Score |
|---|---|---|
| 7 | FTFWRGPVV | 6.741 |
| 1 | NLPLRLFTF | 0.994 |
| 8 | TFWRGPVVV | 0.164 |
| 5 | RLFTFWRGP | 0.071 |
| 2 | LPLRLFTFW | 0.032 |
| 6 | LFTFWRGPV | 0.011 |
| 3 | PLRLFTFWR | 0.003 |

TABLE X-continued

V14-A0201-9mers-98P4B6
Each peptide is a portion of SEQ ID NO: 29; each start position is specified, the length of peptide is 9 amino acids, and the end position for each peptide is the start position plus eight.

| Start | Subsequence | Score |
|---|---|---|
| 4 | LRLFTFWRG | 0.001 |
| 9 | FWRGPVVVA | 0.000 |

TABLE X

V21-A0201-9mers-98P4B6
Each peptide is a portion of SEQ ID NO: 43; each start position is specified, the length of peptide is 9 amino acids, and the end position for each peptide is the start position plus eight.

| Start | Subsequence | Score |
|---|---|---|
| 8 | KTKHCMFSL | 0.485 |
| 5 | QEQKTKHCM | 0.097 |
| 2 | KLTQEQKTK | 0.052 |
| 1 | SKLTQEQKT | 0.038 |
| 4 | TQEQKTKHC | 0.032 |
| 9 | TKHCMFSLI | 0.028 |
| 3 | LTQEQKTKH | 0.007 |
| 7 | QKTKHCMFS | 0.001 |
| 6 | EQKTKHCMF | 0.000 |

TABLE X

V25-A0201-9mers-98P4B6
Each peptide is a portion of SEQ ID NO: 51; each start position is specified, the length of peptide is 9 amino acids, and the end position for each peptide is the start position plus eight.

| Start | Subsequence | Score |
|---|---|---|
| 3 | FLPCISQKL | 98.267 |
| 6 | CISQKLKRI | 3.299 |
| 1 | ILFLPCISQ | 0.094 |
| 9 | QKLKRIKKG | 0.001 |
| 4 | LPCISQKLK | 0.000 |
| 2 | LFLPCISQK | 0.000 |
| 8 | SQKLKRIKK | 0.000 |
| 7 | ISQKLKRIK | 0.000 |
| 5 | PCISQKLKR | 0.000 |

TABLE X

V8-HLA-A0201-10mers-98P4B6
Each peptide is a portion of SEQ ID NO: 17; each start position is specified, the length of peptide is 10 amino acids, and the end position for each peptide is the start position plus nine.

| Start | Subsequence | Score |
|---|---|---|
| 5 | FLEEGMGGTI | 1.637 |
| 8 | EGMGGTIPHV | 0.290 |
| 3 | SQFLEEGMGG | 0.028 |
| 4 | QFLEEGMGGT | 0.023 |
| 9 | GMGGTIPHVS | 0.022 |
| 1 | EKSQFLEEGM | 0.000 |
| 2 | KSQFLEEGMG | 0.000 |
| 10 | MGGTIPHVSP | 0.000 |
| 7 | EEGMGGTIPH | 0.000 |
| 6 | LEEGMGGTIP | 0.000 |

TABLE X

V-13-HLA-A0201-10mers-98P4B6
Each peptide is a portion of SEQ ID NO: 27; each start position is specified, the length of peptide is 10 amino acids, and the end position for each peptide is the start position plus nine.

| Start | Subsequence | Score |
|---|---|---|
| 5 | SLSETFLPNG | 2.670 |
| 9 | TFLPNGINGI | 0.062 |
| 2 | SPKSLSETFL | 0.027 |
| 4 | KSLSETFLPN | 0.012 |
| 6 | LSETFLPNGI | 0.007 |
| 10 | FLPNGINGIK | 0.004 |
| 8 | ETFLPNGING | 0.000 |
| 1 | GSPKSLSETF | 0.000 |
| 7 | SETFLPNGIN | 0.000 |
| 3 | PKSLSETFLP | 0.000 |

TABLE X

V14-HLA-A0201-10mers-98P4B6
Each peptide is a portion of SEQ ID NO: 29; each start position is specified, the length of peptide is 10 amino acids, and the end position for each peptide is the start position plus nine.

| Start | Subsequence | Score |
|---|---|---|
| 6 | RLFTFWRGPV | 33.455 |
| 8 | FTFWRGPVVV | 6.741 |

TABLE X-continued

V14-HLA-A0201-10mers-98P4B6
Each peptide is a portion of SEQ ID NO: 29;
each start position is specified, the
length of peptide is 10 amino acids, and
the end position for each peptide is the
start position plus nine.

| Start | Subsequence | Score |
|---|---|---|
| 2 | NLPRLFTFW | 0.779 |
| 3 | LPLRLFTFWR | 0.074 |
| 7 | LFTFWRGPVV | 0.034 |
| 9 | TFWRGPVVVA | 0.027 |
| 1 | ENLPRLFTF | 0.002 |
| 4 | PLRLFTFWRG | 0.002 |
| 10 | FWRGPVVVAI | 0.001 |
| 5 | LRLFTFWRGP | 0.000 |

TABLE X

V21-HLA-A0201-10mers-98P4B6
Each peptide is a portion of SEQ ID NO: 43;
each start position is specified, the
length of peptide is 10 amino acids, and
the end position for each peptide is the
start position plus nine.

| Start | Subsequence | Score |
|---|---|---|
| 5 | TQEQKTKHCM | 0.135 |
| 4 | LTQEQKTKHC | 0.025 |
| 3 | KLTQEQKTKH | 0.010 |
| 2 | SKLTQEQKTK | 0.010 |
| 9 | KTKHCMFSLI | 0.003 |
| 10 | TKHCMFSLIS | 0.003 |
| 1 | LSKLTQEQKT | 0.002 |
| 7 | EQKTKHCMFS | 0.001 |
| 6 | QEQKTKHCMF | 0.001 |
| 8 | QKTKHCMFSL | 0.000 |

TABLE X

V25-HLA-A0201-10mers-98P4B6
Each peptide is a portion of SEQ ID NO: 51;
each start position is specified, the
length of peptide is 10 amino acids, and
the end position for each peptide is the
start position plus nine.

| Start | Subsequence | Score |
|---|---|---|
| 2 | ILFLPCISQK | 0.216 |
| 3 | LFLPCISQKL | 0.093 |
| 4 | FLPCISQKLK | 0.069 |

TABLE X-continued

V25-HLA-A0201-10mers-98P4B6
Each peptide is a portion of SEQ ID NO: 51;
each start position is specified, the
length of peptide is 10 amino acids, and
the end position for each peptide is the
start position plus nine.

| Start | Subsequence | Score |
|---|---|---|
| 1 | IILFLPCISQ | 0.013 |
| 6 | PCISQKLKRI | 0.003 |
| 9 | SQKLKRIKKG | 0.001 |
| 10 | QKLKRIKKGW | 0.000 |
| 7 | CISQKLKRIK | 0.000 |
| 8 | ISQKLKRIKK | 0.000 |
| 5 | LPCISQKLKR | 0.000 |

TABLE XII

V8-HLA-A3-9mers-98P4B6
Each peptide is a portion of SEQ ID NO: 43;
each start position is specified, the
length of peptide is 9 amino acids, and the
end position for each peptide is the start
position plus eight.

| Start | Subsequence | Score |
|---|---|---|
| 8 | GMGGTIPHV | 1.350 |
| 4 | FLEEGMGGT | 0.068 |
| 1 | KSQFLEEGM | 0.003 |
| 2 | SQFLEEGMG | 0.001 |
| 5 | LEEGMGGTI | 0.001 |
| 7 | EGMGGTIPH | 0.000 |
| 3 | QFLEEGMGG | 0.000 |
| 9 | MGGTIPHVS | 0.000 |
| 6 | EEGMGGTIP | 0.000 |

TABLE XII

V13-HLA-A3-9mers-98P4B6
Each peptide is a portion of SEQ ID NO: 27;
each start position is specified, the
length of peptide is 9 amino acids, and the
end position for each peptide is the start
position plus eight.

| Start | Subsequence | Score |
|---|---|---|
| 9 | FLPNGINGI | 0.900 |
| 4 | SLSETFLPN | 0.180 |
| 1 | SPKSLSETF | 0.020 |
| 1 | SETFLPNGI | 0.002 |
| 3 | KSLSETFLP | 0.001 |
| 7 | ETFLPNGIN | 0.001 |

TABLE XII-continued

V13-HLA-A3-9mers-98P4B6
Each peptide is a portion of SEQ ID NO: 27;
each start position is specified, the
length of peptide is 9 amino acids, and the
end position for each peptide is the start
position plus eight.

| Start | Subsequence | Score |
|---|---|---|
| 5 | LSETFLPNG | 0.000 |
| 8 | TFLPNGING | 0.000 |
| 2 | PKSLSETFL | 0.000 |

TABLE XII

V14-HLA-A3-9mers-98P4B6
Each peptide is a portion of SEQ ID NO: 29;
each start position is specified, the
length of peptide is 9 amino acids, and the
end position for each peptide is the start
position plus eight.

| Start | Subsequence | Score |
|---|---|---|
| 1 | NLPLRLFTF | 9.000 |
| 3 | PLRLFTFWR | 3.600 |
| 7 | FTFWRGPVV | 0.050 |
| 5 | RLFTFWRGP | 0.030 |
| 2 | LPLRLFTFW | 0.009 |
| 9 | FWRGPVVVA | 0.001 |
| 8 | TFWRGPVVV | 0.001 |
| 4 | LRLFTFWRG | 0.000 |
| 6 | LFTFWRGPV | 0.000 |

TABLE XII

V21-HLA-A3-9mers-98P4B6
Each peptide is a portion of SEQ ID NO: 43;
each start position is specified, the
length of peptide is 9 amino acids, and the
end position for each peptide is the start
position plus eight.

| Start | Subsequence | Score |
|---|---|---|
| 2 | KLTQEQKTK | 30.000 |
| 8 | KTKHCMFSL | 0.405 |
| 6 | EQKTKHCMF | 0.018 |
| 3 | LTQEQKTKH | 0.015 |
| 4 | TQEQKTKHC | 0.003 |
| 9 | TKHCMFSLI | 0.002 |
| 5 | QEQKTKHCM | 0.001 |
| 1 | SKLTQEQKT | 0.000 |
| 7 | QKTKHCMFS | 0.000 |

TABLE XII

V25-HLA-A3-9mers-98P4B6
Each peptide is a portion of SEQ ID NO: 51;
each start position is specified, the
length of peptide is 9 amino acids, and the
end position for each peptide is the start
position plus eight.

| Start | Subsequence | Score |
|---|---|---|
| 8 | SQKLKRIKK | 1.200 |
| 3 | FLPCISQKL | 0.900 |
| 1 | ILFLPCISQ | 0.300 |
| 4 | LPCISQKLK | 0.100 |
| 2 | LFLPCISQK | 0.068 |
| 6 | CISQKLKRI | 0.045 |
| 5 | PCISQKLKR | 0.012 |
| 7 | ISQKLKRIK | 0.010 |
| 9 | QKLKRIKKG | 0.000 |

TABLE XIII

V8-HLA-A3-10mers-98P4B6
Each peptide is a portion of SEQ ID NO: 17;
each start position is specified, the
length of peptide is 10 amino acids, and
the end position for each peptide is the
start position plus nine.

| Start | Subsequence | Score |
|---|---|---|
| 9 | GMGGTIPHVS | 0.270 |
| 5 | FLEEGMGGTI | 0.270 |
| 3 | SQFLEEGMGG | 0.006 |
| 7 | EEGMGGTIPH | 0.000 |
| 8 | EGMGGTIPHV | 0.000 |
| 4 | QFLEEGMGGT | 0.000 |
| 6 | LEEGMGGTIP | 0.000 |
| 2 | KSQFLEEGMG | 0.000 |
| 1 | EKSQFLEEGM | 0.000 |
| 10 | MGGTIPHVSP | 0.000 |

TABLE XIII

V13-HLA-A3-10mers-98P4B6
Each peptide is a portion of SEQ ID NO: 27;
each start position is specified, the
length of peptide is 10 amino acids, and
the end position for each peptide is the
start position plus nine.

| Start | Subsequence | Score |
|---|---|---|
| 10 | FLPNGINGIK | 9.000 |
| 5 | SLSETFLPNG | 0.135 |
| 1 | GSPKSLSETF | 0.030 |

TABLE XIII-continued

V13-HLA-A3-10mers-98P4B6
Each peptide is a portion of SEQ ID NO: 27;
each start position is specified, the
length of peptide is 10 amino acids, and
the end position for each peptide is the
start position plus nine.

| Start | Subsequence | Score |
|---|---|---|
| 2 | SPKSLSETFL | 0.006 |
| 6 | LSETFLPNGI | 0.003 |
| 8 | ETFLPNGING | 0.003 |
| 4 | KSLSETFLPN | 0.003 |
| 9 | TFLPNGINGI | 0.002 |
| 7 | SETFLPNGIN | 0.000 |
| 3 | PKSLSETFLP | 0.000 |

TABLE XIII

V14-HLA-A3-10mers-98P4B6
Each peptide is a portion of SEQ ID NO: 29;
each start position is specified, the
length of peptide is 10 amino acids, and
the end position for each peptide is the
start position plus nine.

| Start | Subsequence | Score |
|---|---|---|
| 6 | RLFTFWRGPV | 0.900 |
| 2 | NLPLRLFTFW | 0.600 |
| 3 | LPLRLFTFWR | 0.540 |
| 6 | FTFWRGPVVV | 0.050 |
| 4 | PLRLFTFWRG | 0.018 |
| 1 | ENLPLRLFTF | 0.012 |
| 9 | TFWRGPVVVA | 0.005 |
| 10 | FWRGPVVVAI | 0.004 |
| 7 | LFTFWRGPVV | 0.000 |
| 5 | LRLFTFWRGP | 0.000 |

TABLE XIII

V21-HLA-A3-10mers-98P4B6
Each peptide is a portion of SEQ ID NO: 43;
each start position is specified, the length of peptide
is 10 amino acids, and the end position for each
peptide is the start position plus nine.

| Start | Subsequence | Score |
|---|---|---|
| 3 | KLTQEQKTKH | 0.600 |
| 9 | KTKHCMFSLI | 0.270 |
| 2 | SKLTQEQKTK | 0.015 |
| 4 | LTQEQKTKHC | 0.007 |
| 6 | QEQKTKHCMF | 0.006 |

TABLE XIII-continued

V21-HLA-A3-10mers-98P4B6
Each peptide is a portion of SEQ ID NO: 43; each
start position is specified, the length of peptide
is 10 amino acids, and the end position for each
peptide is the start position plus nine.

| Start | Subsequence | Score |
|---|---|---|
| 5 | TQEQKTKHCM | 0.006 |
| 8 | QKTKHCMFSL | 0.003 |
| 7 | EQKTKHCMFS | 0.001 |
| 1 | LSKLTQEQKT | 0.001 |
| 10 | TKHCMFSLIS | 0.000 |

TABLE XIII

V25-HLA-A3-10mers-98P4B6
Each peptide is a portion of SEQ ID NO: 51; each
start position is specified, the length of peptide
is 10 amino acids, and the end position for each
peptide is the start position plus nine.

| Start | Subsequence | Score |
|---|---|---|
| 2 | ILFLPCISQK | 150.000 |
| 4 | FLPCISQKLK | 10.000 |
| 8 | ISQKLKRIKK | 0.200 |
| 7 | CISQKLKRIK | 0.200 |
| 5 | LPCISQKLKR | 0.080 |
| 1 | IILFLPCISQ | 0.009 |
| 3 | LFLPCISQKL | 0.002 |
| 6 | PCISQKLKRI | 0.001 |
| 9 | SQKLKRIKKG | 0.000 |
| 10 | QKLKRIKKGW | 0.000 |

TABLE XIV

V8-HLA-A1101-9mers-98P4B6
Each peptide is a portion of SEQ ID NO: 17; each
start position is specified, the length of peptide
is 9 amino acids, and the end position for each
peptide is the start position plus eight.

| Start | Subsequence | Score |
|---|---|---|
| 8 | GMGGTIPHV | 1.350 |
| 4 | FLEEGMGGT | 0.068 |
| 1 | KSQFLEEGM | 0.003 |
| 2 | SQFLEEGMG | 0.001 |
| 5 | LEEGMGGTI | 0.001 |
| 7 | EGMGGTIPH | 0.000 |
| 3 | QFLEEGMGG | 0.000 |

TABLE XIV-continued

V8-HLA-A1101-9mers-98P4B6
Each peptide is a portion of SEQ ID NO: 17; each start position is specified, the length of peptide is 9 amino acids, and the end position for each peptide is the start position plus eight.

| Start | Subsequence | Score |
|---|---|---|
| 9 | MGGTIPHVS | 0.000 |
| 6 | EEGMGGTIP | 0.000 |

TABLE XIV

V13-HLA-A1101-9mers-98P4B6
Each peptide is a portion of SEQ ID NO: 27; each start position is specified, the length of peptide is 9 amino acids, and the end position for each peptide is the start position plus eight.

| Start | Subsequence | Score |
|---|---|---|
| 9 | FLPNGINGI | 0.004 |
| 1 | SPKSLSETF | 0.002 |
| 4 | SLSETFLPN | 0.001 |
| 7 | ETFLPNGIN | 0.001 |
| 8 | TFLPNGING | 0.001 |
| 6 | SETFLPNGI | 0.001 |
| 3 | KSLSETFLP | 0.000 |
| 2 | PKSLSETFL | 0.000 |
| 5 | LSETFLPNG | 0.000 |

TABLE XIV

V14-HLA-A1101-9mers-98P4B6
Each peptide is a portion of SEQ ID NO: 29; each start position is specified, the length of peptide is 9 amino acids, and the end position for each peptide is the start position plus eight.

| Start | Subsequence | Score |
|---|---|---|
| 3 | PLRLFTFWR | 0.024 |
| 7 | FTFWRGPVV | 0.020 |
| 1 | NLPLRLFTF | 0.012 |
| 8 | TFWRGPVVV | 0.004 |
| 2 | LPLRLFTFW | 0.003 |
| 6 | LFTFWRGPV | 0.002 |
| 5 | RLFTFWRGP | 0.000 |
| 9 | FWRGPVVVA | 0.000 |
| 4 | LRLFTFWRG | 0.000 |

TABLE XIV

V21-HLA-A1101-9mers-98P4B6
Each peptide is a portion of SEQ ID NO: 43; each start position is specified, the length of peptide is 9 amino acids, and the end position for each peptide is the start position plus eight.

| Start | Subsequence | Score |
|---|---|---|
| 2 | KLTQEQKTK | 0.600 |
| 8 | KTKHCMFSL | 0.090 |
| 3 | LTQEQKTKH | 0.010 |
| 6 | EQKTKHCMF | 0.002 |
| 5 | QEQKTKHCM | 0.001 |
| 4 | TQEQKTKHC | 0.000 |
| 9 | TKHCMFSLI | 0.000 |
| 7 | QKTKHCMFS | 0.000 |
| 1 | SKLTQEQKT | 0.000 |

TABLE XIV

V25-HLA-A1101-9mers-98P4B6
Each peptide is a portion of SEQ ID NO: 51; each start position is specified, the length of peptide is 9 amino acids, and the end position for each peptide is the start position plus eight.

| Start | Subsequence | Score |
|---|---|---|
| 8 | SQKLKRIKK | 1.200 |
| 2 | LFLPCISQK | 0.300 |
| 4 | LPCISQKLK | 0.100 |
| 5 | PCISQKLKR | 0.012 |
| 3 | FLPCISQKL | 0.004 |
| 7 | ISQKLKRIK | 0.002 |
| 6 | CISQKLKRI | 0.002 |
| 1 | ILFLPCISQ | 0.002 |
| 9 | QKLKRIKKG | 0.000 |

TABLE XV

V8-HLA-A11-10mers-98P4B6
Each peptide is a portion of SEQ ID NO: 17; each start position is specified, the length of peptide is 10 amino acids, and the end position for each peptide is the start position plus nine.

| Start | Subsequence | Score |
|---|---|---|
| 5 | FLEEGMGGTI | 0.004 |
| 3 | SQFLEEGMGG | 0.002 |
| 9 | GMGGTIPHVS | 0.001 |
| 7 | EEGMGGTIPH | 0.000 |
| 4 | QFLEEGMGGT | 0.000 |

TABLE XV-continued

V8-HLA-A11-10mers-98P4B6
Each peptide is a portion of SEQ ID NO: 17; each start position is specified, the length of peptide is 10 amino acids, and the end position for each peptide is the start position plus nine.

| Start | Subsequence | Score |
|---|---|---|
| 8 | EGMGGTIPHV | 0.000 |
| 2 | KSQFLEEGMG | 0.000 |
| 6 | LEEGMGGTIP | 0.000 |
| 1 | EKSQFLEEGM | 0.000 |
| 10 | MGGTIPHVSP | 0.000 |

TABLE XV

V13-HLA-A11-10mers-98P4B6
Each peptide is a portion of SEQ ID NO: 27; each start position is specified, the length of peptide is 10 amino acids, and the end position for each peptide is the start position plus nine.

| Start | Subsequence | Score |
|---|---|---|
| 10 | FLPNGINGIK | 0.400 |
| 9 | TFLPNGINGI | 0.003 |
| 2 | SPKSLSETFL | 0.002 |
| 8 | ETFLPNGING | 0.001 |
| 1 | GSPKSLSETF | 0.001 |
| 5 | SLSETFLPNG | 0.000 |
| 6 | LSETFLPNGI | 0.000 |
| 4 | KSLSETFLPN | 0.000 |
| 7 | SETFLPNGIN | 0.000 |
| 3 | PKSLSETFLP | 0.000 |

TABLE XV

V14-HLA-A11-10mers-98P4B6
Each peptide is a portion of SEQ ID NO: 29; each start position is specified, the length of peptide is 10 amino acids, and the end position for each peptide is the start position plus nine.

| Start | Subsequence | Score |
|---|---|---|
| 3 | LPLRLFTFWR | 0.180 |
| 6 | RLFTFWRGPV | 0.024 |
| 8 | FTFWRGPVVV | 0.020 |
| 9 | TFWRGPVVVA | 0.004 |
| 2 | NLPLRLFTFW | 0.004 |
| 7 | LFTFWRGPVV | 0.002 |
| 1 | ENLPLRLFTF | 0.001 |
| 10 | FWRGPVVVAI | 0.000 |

TABLE XV-continued

V14-HLA-A11-10mers-98P4B6
Each peptide is a portion of SEQ ID NO: 29; each start position is specified, the length of peptide is 10 amino acids, and the end position for each peptide is the start position plus nine.

| Start | Subsequence | Score |
|---|---|---|
| 4 | PLRLFTFWRG | 0.000 |
| 5 | LRLFTFWRGP | 0.000 |

TABLE XV

V21-HLA-A11-10mers-98P4B6
Each peptide is a portion of SEQ ID NO: 43; each start position is specified, the length of peptide is 10 amino acids, and the end position for each peptide is the start position plus eight.

| Start | Subsequence | Score |
|---|---|---|
| 9 | KTKHCMFSLI | 0.030 |
| 2 | SKLTQEQKTK | 0.015 |
| 3 | KLTQEQKTKH | 0.012 |
| 5 | TQEQKTKHCM | 0.006 |
| 8 | QKTKHCMFSL | 0.001 |
| 6 | QEQKTKHCMF | 0.001 |
| 4 | LTQEQKTKHC | 0.001 |
| 7 | EQKTKHCMFS | 0.000 |
| 10 | TKHCMFSLIS | 0.000 |
| 1 | LSKLTQEQKT | 0.000 |

TABLE XV

V25-HLA-A11-10mers-98P4B6
Each peptide is a portion of SEQ ID NO: 51; each start position is specified, the length of peptide is 10 amino acids, and the end position for each peptide is the start position plus nine.

| Start | Subsequence | Score |
|---|---|---|
| 2 | ILFLPCISQK | 0.800 |
| 4 | FLPCISQKLK | 0.200 |
| 5 | LPCISQKLKR | 0.080 |
| 8 | ISQKLKRIKK | 0.040 |
| 7 | CISQKLKRIK | 0.040 |
| 3 | LFLPCISQKL | 0.040 |
| 1 | IILFLPCISQ | 0.001 |
| 9 | SQKLKRIKKG | 0.000 |
| 10 | QKLKRIKKGW | 0.000 |
| 6 | PCISQKLKRI | 0.000 |

TABLE XVI

V8-HLA-A24-9mers-98P4B6
Each peptide is a portion of SEQ ID NO: 17; each start position is specified, the length of peptide is 9 amino acids, and the end position for each peptide is the start position plus eight.

| Start | Subsequence | Score |
|---|---|---|
| 1 | KSQFLEEGM | 1.800 |
| 4 | FLEEGMGGT | 0.180 |
| 5 | LEEGMGGTI | 0.150 |
| 9 | MGGTIPHVS | 0.140 |
| 8 | GMGGTIPHV | 0.100 |
| 3 | QFLEEGMGG | 0.090 |
| 7 | EGMGGTIPH | 0.015 |
| 2 | SQFLEEGMG | 0.010 |
| 6 | EEGMGGTIP | 0.001 |

TABLE XVI

V13-HLA-A24-9mers-98P4B6
Each peptide is a portion of SEQ ID NO: 27; each start position is specified, the length of peptide is 9 amino acids, and the end position for each peptide is the start position plus eight.

| Start | Subsequence | Score |
|---|---|---|
| 1 | SPKSLSETF | 2.400 |
| 9 | FLPNGINGI | 1.800 |
| 4 | SLSETFLPN | 0.144 |
| 6 | SETFLPNGI | 0.144 |
| 7 | ETFLPNGIN | 0.100 |
| 8 | TFLPNGING | 0.090 |
| 2 | PKSLSETFL | 0.040 |
| 3 | KSLSETFLP | 0.030 |
| 5 | LSETFLPNG | 0.015 |

TABLE XVI

V14-HLA-A24-9mers-98P4B6
Each peptide is a portion of SEQ ID NO: 29; each start position is specified, the length of peptide is 9 amino acids, and the end position for each peptide is the start position plus eight.

| Start | Subsequence | Score |
|---|---|---|
| 1 | NLPLRLFTF | 3.000 |
| 8 | TFWRGPVVV | 0.500 |
| 6 | LFTFWRGPV | 0.500 |
| 2 | LPLRLFTFW | 0.216 |
| 7 | FTFWRGPVV | 0.100 |

TABLE XVI-continued

V14-HLA-A24-9mers-98P4B6
Each peptide is a portion of SEQ ID NO: 29; each start position is specified, the length of peptide is 9 amino acids, and the end position for each peptide is the start position plus eight.

| Start | Subsequence | Score |
|---|---|---|
| 9 | FWRGPVVVA | 0.100 |
| 5 | RLFTFWRGP | 0.020 |
| 4 | LRLFTFWRG | 0.002 |
| 3 | PLRLFTFWR | 0.001 |

TABLE XVI

V21-HLA-A24-9mers-98P4B6
Each peptide is a portion of SEQ ID NO: 43; each start position is specified, the length of peptide is 9 amino acids, and the end position for each peptide is the start position plus eight.

| Start | Subsequence | Score |
|---|---|---|
| 8 | KTKHCMFSL | 8.000 |
| 6 | EQKTKHCMF | 2.000 |
| 4 | TQEQKTKHC | 0.150 |
| 9 | TKHCMFSLI | 0.120 |
| 5 | QEQKTKHCM | 0.075 |
| 2 | KLTQEQKTK | 0.020 |
| 1 | SKLTQEQKT | 0.020 |
| 3 | LTQEQKTKH | 0.020 |
| 7 | QKTKHCMFS | 0.010 |

TABLE XVI

V25-HLA-A24-9mers-98P4B6
Each peptide is a portion of SEQ ID NO: 51; each start position is specified, the length of peptide is 9 amino acids, and the end position for each peptide is the start position plus eight.

| Start | Subsequence | Score |
|---|---|---|
| 3 | FLPCISQKL | 11.088 |
| 6 | CISQKLKRI | 1.000 |
| 2 | LFLPCISQK | 0.090 |
| 7 | ISQKLKRIK | 0.018 |
| 8 | SQKLKRIKK | 0.011 |
| 1 | ILFLPCISQ | 0.010 |
| 4 | LPCISQKLK | 0.010 |
| 9 | QKLKRIKKG | 0.002 |
| 5 | PCISQKLKR | 0.002 |

TABLE XVII

V8-HLA-A24-10mers-98P4B6
Each peptide is a portion of SEQ ID NO: 17; each start position is specified, the length of peptide is 10 amino acids, and the end position for each peptide is the start position plus nine.

| Start | Subsequence | Score |
|---|---|---|
| 5 | FLEEGMGGTI | 1.800 |
| 4 | QFLEEGMGGT | 0.900 |
| 8 | EGMGGTIPHV | 0.150 |
| 9 | GMGGTIPHVS | 0.140 |
| 1 | EKSQFLEEGM | 0.060 |
| 2 | KSQFLEEGMG | 0.030 |
| 10 | MGGTIPHVSP | 0.010 |
| 3 | SQFLEEGMGG | 0.010 |
| 6 | LEEGMGGTIP | 0.002 |
| 7 | EEGMGGTIPH | 0.001 |

TABLE XVII

V13-HLA-A24-10mers-98P4B6
Each peptide is a portion of SEQ ID NO: 27; each start position is specified, the length of peptide is 10 amino acids, and the end position for each peptide is the start position plus nine.

| Start | Subsequence | Score |
|---|---|---|
| 9 | TFLPNGINGI | 10.800 |
| 2 | SPKSLSETFL | 4.000 |
| 1 | GSPKSLSETF | 3.600 |
| 6 | LSETFLPNGI | 2.160 |
| 4 | KSLSETFLPN | 0.360 |
| 10 | FLPNGINGIK | 0.021 |
| 5 | SLSETFLPNG | 0.012 |
| 7 | SETFLPNGIN | 0.010 |
| 8 | ETFLPNGING | 0.010 |
| 3 | PKSLSETFLP | 0.000 |

TABLE XVII

V14-HLA-A24-10mers-98P4B6
Each peptide is a portion of SEQ ID NO: 29; each start position is specified, the length of peptide is 10 amino acids, and the end position for each peptide is the start position plus nine.

| Start | Subsequence | Score |
|---|---|---|
| 1 | ENLPLRLFTF | 3.600 |
| 10 | FWRGPVVAI | 1.400 |
| 7 | LFTFWRGPVV | 0.500 |

TABLE XVII-continued

V14-HLA-A24-10mers-98P4B6
Each peptide is a portion of SEQ ID NO: 29; each start position is specified, the length of peptide is 10 amino acids, and the end position for each peptide is the start position plus nine.

| Start | Subsequence | Score |
|---|---|---|
| 9 | TFWRGPVVVA | 0.500 |
| 2 | NLPLRLFTFW | 0.216 |
| 6 | RLFTFWRGPV | 0.200 |
| 8 | FTFWRGPVVV | 0.100 |
| 3 | LPLRLFTFWR | 0.015 |
| 5 | LRLFTFWRGP | 0.002 |
| 4 | PLRLFTFWRG | 0.001 |

TABLE XVII

V21-HLA-A24-10mers-98P4B6
Each peptide is a portion of SEQ ID NO: 43; each start position is specified, the length of peptide is 10 amino acids, and the end position for each peptide is the start position plus nine.

| Start | Subsequence | Score |
|---|---|---|
| 9 | KTKHCMFSLI | 2.400 |
| 5 | TQEQKTKHCM | 0.750 |
| 8 | QKTKHCMFSL | 0.400 |
| 6 | QEQKTKHCMF | 0.300 |
| 4 | LTQEQKTKHC | 0.180 |
| 1 | LSKLTQEQKT | 0.132 |
| 7 | EQKTKHCMFS | 0.100 |
| 3 | KLTQEQKTKH | 0.022 |
| 10 | TKHCMFSLIS | 0.010 |
| 2 | SKLTQEQKTK | 0.002 |

TABLE XVII

V25-HLA-A24-10mers-98P4B6
Each peptide is a portion of SEQ ID NO: 51; each start position is specified, the length of peptide is 10 amino acids, and the end position for each peptide is the start position plus nine.

| Start | Subsequence | Score |
|---|---|---|
| 3 | LFLPCISQKL | 66.528 |
| 6 | PCISQKLKRI | 0.150 |
| 10 | QKLKRIKKGW | 0.021 |
| 8 | ISQKLKRIKK | 0.017 |
| 4 | FLPCISQKLK | 0.015 |
| 1 | IILFLPCISQ | 0.015 |

TABLE XVII-continued

V25-HLA-A24-10mers-98P4B6
Each peptide is a portion of SEQ ID NO: 51; each start position is specified, the length of peptide is 10 amino acids, and the end position for each peptide is the start position plus nine.

| Start | Subsequence | Score |
|---|---|---|
| 7 | CISQKLKRIK | 0.012 |
| 9 | SQKLKRIKKG | 0.011 |
| 5 | LPCISQKLKR | 0.011 |
| 2 | ILFLPCISQK | 0.010 |

TABLE XVIII

V8-HLA-B7-9mers-98P4B6
Each peptide is a portion of SEQ ID NO: 17; each start position is specified, the length of peptide is 9 amino acids, and the end position for each peptide is the start position plus eight.

| Start | Subsequence | Score |
|---|---|---|
| 1 | KSQFLEEGM | 1.000 |
| 8 | GMGGTIPHV | 0.200 |
| 7 | EGMGGTIPH | 0.030 |
| 4 | FLEEGMGGT | 0.030 |
| 9 | MGGTIPHVS | 0.020 |
| 5 | LEEGMGGTI | 0.012 |
| 2 | SQFLEEGMG | 0.010 |
| 6 | EEGMGGTIP | 0.001 |
| 3 | QFLEEGMGG | 0.001 |

TABLE XVIII

V13-HLA-B7-9mers-98P4B6
Each peptide is a portion of SEQ ID NO: 27; each start position is specified, the length of peptide is 0 amino acids, and the end position for each peptide is the start position plus eight.

| Start | Subsequence | Score |
|---|---|---|
| 9 | FLPNGINGI | 0.400 |
| 1 | SPKSLSETF | 0.400 |
| 6 | SETFLPNGI | 0.040 |
| 2 | PKSLSETFL | 0.040 |
| 7 | ETFLPNGIN | 0.030 |
| 4 | SLSETFLPN | 0.020 |
| 3 | KSLSETFLP | 0.010 |
| 5 | LSETFLPNG | 0.003 |
| 8 | TFLPNGING | 0.001 |

TABLE XVIII

V14-HLA-B7-9mers-98P4B6
Each peptide is a portion of SEQ ID NO: 29; each start position is specified, the length of peptide is 9 amino acids, and the end position for each peptide is the start position plus eight.

| Start | Subsequence | Score |
|---|---|---|
| 2 | LPLRLFTFW | 0.400 |
| 7 | FTFWRGPVV | 0.200 |
| 9 | FWRGPVVVA | 0.150 |
| 6 | LFTFWRGPV | 0.030 |
| 8 | TFWRGPVVV | 0.020 |
| 1 | NLPLRLFTF | 0.020 |
| 3 | PLRLFTFWR | 0.010 |
| 5 | RLFTFWRGP | 0.010 |
| 4 | LRLFTFWRG | 0.001 |

TABLE XVIII

V21-HLA-B7-9mers-98P4B6
Each peptide is a portion of SEQ ID NO: 43; each start position is specified, the length of peptide is 9 amino acids, and the end position for each peptide is the start position plus eight.

| Start | Subsequence | Score |
|---|---|---|
| 8 | KTKHCMFSL | 4.000 |
| 5 | QEQKTKHCM | 0.100 |
| 9 | TKHCMFSLI | 0.040 |
| 4 | TQEQKTKHC | 0.030 |
| 6 | EQKTKHCMF | 0.020 |
| 3 | LTQEQKTKH | 0.010 |
| 1 | SKLTQEQKT | 0.010 |
| 2 | KLTQEQKTK | 0.010 |
| 7 | QKTKHCMFS | 0.002 |

TABLE XVIII

V25-HLA-B7-9mers-98P4B6
Each peptide is a portion of SEQ ID NO: 51; each start position is specified, the length of peptide is 9 amino acids, and the end position for each peptide is the start position plus eight.

| Start | Subsequence | Score |
|---|---|---|
| 3 | FLPCISQKL | 4.000 |
| 6 | CISQKLKRI | 0.400 |
| 4 | LPCISQKLK | 0.200 |
| 8 | SQKLKRIKK | 0.015 |
| 1 | ILFLPCISQ | 0.015 |

TABLE XVIII-continued

V25-HLA-B7-9mers-98P4B6
Each peptide is a portion of SEQ ID NO: 51; each start position is specified, the length of peptide is 9 amino acids, and the end position for each peptide is the start position plus eight.

| Start | Subsequence | Score |
|---|---|---|
| 7 | ISQKLKRIK | 0.010 |
| 9 | QKLKRIKKG | 0.001 |
| 2 | LFLPCISQK | 0.001 |
| 5 | PCISQKLKR | 0.001 |

TABLE XIX

V8-HLA-B7-10mers-98P4B6
Each peptide is a portion of SEQ ID NO: 17; each start position is specified, the length of peptide is 10 amino acids, and the end position for each peptide is the start position plus nine.

| Start | Subsequence | Score |
|---|---|---|
| 9 | EGMGGTIPHV | 0.600 |
| 5 | FLEEGMGGTI | 0.120 |
| 1 | EKSQFLEEGM | 0.100 |
| 9 | GMGGTIPHVS | 0.020 |
| 10 | MGGTIPHVSP | 0.015 |
| 4 | QFLEEGMGGT | 0.010 |
| 3 | SQFLEEGMGG | 0.010 |
| 2 | KSQFLEEGMG | 0.010 |
| 7 | EEGMGGTIPH | 0.001 |
| 6 | LEEGMGGTIP | 0.000 |

TABLE XIX

V13-HLA-B7-10mers-98P4B6
Each peptide is a portion of SEQ ID NO: 27; each start position is specified, the length of peptide is 10 amino acids, and the end position for each peptide is the start position plus nine.

| Start | Subsequence | Score |
|---|---|---|
| 2 | SPKSLSETFL | 80.000 |
| 6 | LSETFLPNGI | 0.120 |
| 9 | TFLPNGINGI | 0.040 |
| 1 | GSPKSLSETF | 0.020 |
| 4 | KSLSETFLPN | 0.020 |
| 10 | FLPNGINGIK | 0.010 |
| 5 | SLSETFLPNG | 0.010 |
| 8 | ETFLPNGING | 0.010 |

TABLE XIX-continued

V13-HLA-B7-10mers-98P4B6
Each peptide is a portion of SEQ ID NO: 27; each start position is specified, the length of peptide is 10 amino acids, and the end position for each peptide is the start position plus nine.

| Start | Subsequence | Score |
|---|---|---|
| 7 | SETFLPNGIN | 0.003 |
| 3 | PKSLSETFLP | 0.000 |

TABLE XIX

V14-HLA-B7-10mers-98P4B6
Each peptide is a portion of SEQ ID NO: 29; each start position is specified, the length of peptide is 10 amino acids, and the end position for each peptide is the start position plus nine.

| Start | Subsequence | Score |
|---|---|---|
| 10 | FWRGPVVVAI | 0.400 |
| 6 | RLFTFWRGPV | 0.300 |
| 8 | FTFWRGPVVV | 0.200 |
| 3 | LPLRLFTFWR | 0.200 |
| 2 | NLPLRLFTFW | 0.020 |
| 7 | LFTFWRGPVV | 0.020 |
| 1 | ENLPLRLFTF | 0.020 |
| 9 | TFWRGPVVVA | 0.015 |
| 4 | PLRLFTFWRG | 0.010 |
| 5 | LRLFTFWRGP | 0.001 |

TABLE XIX

V21-HLA-B7-10mers-98P4B6
Each peptide is a portion of SEQ ID NO: 43; each start position is specified, the length of peptide is 10 amino acids, and the end position for each peptide is the start position plus nine.

| Start | Subsequence | Score |
|---|---|---|
| 9 | KTKHCMFSLI | 0.400 |
| 8 | QKTKHCMFSL | 0.400 |
| 5 | TQEQKTKHCM | 0.300 |
| 1 | LSKLTQEQKT | 0.100 |
| 4 | LTQEQKTKHC | 0.100 |
| 7 | EQKTKHCMFS | 0.020 |
| 3 | KLTQEQKTKH | 0.010 |
| 10 | TKHCMFSLIS | 0.002 |
| 6 | QEQKTKHCMF | 0.002 |
| 2 | SKLTQEQKTK | 0.001 |

TABLE XIX

V25-HLA-B7-10mers-98P4B6
Each peptide is a portion of SEQ ID NO: 51; each start position is specified, the length of peptide is 10 amino acids, and the end position for each peptide is the start position plus nine.

| Start | Subsequence | Score |
|---|---|---|
| 3 | LFLPCISQKL | 0.400 |
| 5 | LPCISQKLKR | 0.200 |
| 6 | PCISQKLKRI | 0.040 |
| 8 | ISQKLKRIKK | 0.015 |
| 1 | IILFLPCISQ | 0.015 |
| 7 | CISQKLKRIK | 0.010 |
| 4 | FLPCISQKLK | 0.010 |
| 9 | SQKLKRIKKG | 0.010 |
| 2 | ILFLPCISQK | 0.010 |
| 10 | QKLKRIKKGW | 0.002 |

TABLE XX

V8-HLA-B3501-9mers-98P4B6
Each peptide is a portion of SEQ ID NO: 17; each start position is specified, the length of peptide is 9 amino acids, and the end position for each peptide is the start position plus eight.

| Start | Subsequence | Score |
|---|---|---|
| 1 | KSQFLEEGM | 20.000 |
| 8 | GMGGTIPHV | 0.200 |
| 9 | MGGTIPHVS | 0.100 |
| 4 | FLEEGMGGT | 0.060 |
| 2 | SQFLEEGMG | 0.015 |
| 5 | LEEGMGGTI | 0.012 |
| 7 | EGMGGTIPH | 0.010 |
| 3 | QFLEEGMGG | 0.003 |
| 6 | EEGMGGTIP | 0.001 |

TABLE XX

V13-HLA-B3501-9mers-98P4B6
Each peptide is a portion of SEQ ID NO: 27; each start position is specified, the length of peptide is 9 amino acids, and the end position for each peptide is the start position plus eight.

| Start | Subsequence | Score |
|---|---|---|
| 1 | SPKSLSETF | 60.000 |
| 9 | FLPNGINGI | 0.400 |
| 4 | SLSETFLPN | 0.200 |
| 3 | KSLSETFLP | 0.150 |

TABLE XX-continued

V13-HLA-B3501-9mers-98P4B6
Each peptide is a portion of SEQ ID NO: 27; each start position is specified, the length of peptide is 9 amino acids, and the end position for each peptide is the start position plus eight.

| Start | Subsequence | Score |
|---|---|---|
| 7 | ETFLPNGIN | 0.100 |
| 6 | SETFLPNGI | 0.040 |
| 5 | LSETFLPNG | 0.015 |
| 2 | PKSLSETFL | 0.010 |
| 8 | TFLPNGING | 0.001 |

TABLE XX

V14-HLA-B3501-9mers-98P4B6
Each peptide is a portion of SEQ ID NO: 29; each start position is specified, the length of peptide is 9 amino acids, and the end position for each peptide is the start position plus eight.

| Start | Subsequence | Score |
|---|---|---|
| 2 | LPLRLFTFW | 10.000 |
| 1 | NLPLRLFTF | 1.000 |
| 7 | FTFWRGPVV | 0.200 |
| 9 | FWRGPVVVA | 0.030 |
| 6 | LFTFWRGPV | 0.020 |
| 5 | RLFTFWRGP | 0.020 |
| 8 | TFWRGPVVV | 0.020 |
| 3 | PLRLFTFWR | 0.003 |
| 4 | LRLFTFWRG | 0.001 |

TABLE XX

V21-HLA-B3501-9mers-98P4B6
Each peptide is a portion of SEQ ID NO: 43; each start position is specified, the length of peptide is 9 amino acids, and the end position for each peptide is the start position plus eight.

| Start | Subsequence | Score |
|---|---|---|
| 8 | KTKHCMFSL | 6.000 |
| 6 | EQKTKHCMF | 3.000 |
| 5 | QEQKTKHCM | 0.200 |
| 9 | TKHCMFSLI | 0.040 |
| 2 | KLTQEQKTK | 0.030 |
| 4 | TQEQKTKHC | 0.030 |
| 3 | LTQEQKTKH | 0.020 |
| 7 | QKTKHCMFS | 0.010 |
| 1 | SKLTQEQKT | 0.010 |

TABLE XX

V25-HLA-B3501-9mers-98P4B6
Each peptide is a portion of SEQ ID NO: 51; each start position is specified, the length of peptide is 9 amino acids, and the end position for each peptide is the start position plus eight.

| Start | Subsequence | Score |
|---|---|---|
| 3 | FLPCISQKL | 1.000 |
| 6 | CISQKLKRI | 0.400 |
| 4 | LPCISQKLK | 0.200 |
| 7 | ISQKLKRIK | 0.050 |
| 8 | SQKLKRIKK | 0.030 |
| 1 | ILFLPCISQ | 0.010 |
| 9 | QKLKRIKKG | 0.001 |
| 2 | LFLPCISQK | 0.001 |
| 5 | PCISQKLKR | 0.001 |

TABLE XXI

V8-HLA-B35-10mers-98P4B6
Each peptide is a portion of SEQ ID NO: 17; each start position is specified, the length of peptide is 10 amino acids, and the end position for each peptide is the start position plus nine.

| Start | Subsequence | Score |
|---|---|---|
| 5 | FLEEGMGGTI | 0.240 |
| 8 | EGMGGTIPHV | 0.200 |
| 1 | EKSQFLEEGM | 0.200 |
| 2 | KSQFLEEGMG | 0.150 |
| 9 | GMGGTIPHVS | 0.100 |
| 4 | QFLEEGMGGT | 0.020 |
| 3 | SQFLEEGMGG | 0.015 |
| 10 | MGGTIPHVSP | 0.010 |
| 7 | EEGMGGTIPH | 0.001 |
| 6 | LEEGMGGTIP | 0.000 |

TABLE XXI

V13-HLA-B35-10mers-98P4B6
Each peptide is a portion of SEQ ID NO: 27; each start position is specified, the length of peptide is 10 amino acids, and the end position for each peptide is the start position plus nine.

| Start | Subsequence | Score |
|---|---|---|
| 2 | SPKSLSETFL | 60.000 |
| 1 | GSPKSLSETF | 5.000 |
| 4 | KSLSETFLPN | 1.000 |
| 6 | LSETFLPNGI | 0.600 |

TABLE XXI-continued

V13-HLA-B35-10mers-98P4B6
Each peptide is a portion of SEQ ID NO: 27; each start position is specified, the length of peptide is 10 amino acids, and the end position for each peptide is the start position plus nine.

| Start | Subsequence | Score |
|---|---|---|
| 9 | TFLPNGINGI | 0.040 |
| 5 | SLSETFLPNG | 0.020 |
| 10 | FLPNGINGIK | 0.010 |
| 7 | SETFLPNGIN | 0.010 |
| 8 | ETFLPNGING | 0.010 |
| 3 | PKSLSETFLP | 0.000 |

TABLE XXI

V14-HLA-B35-10mers-98P4B6
Each peptide is a portion of SEQ ID NO: 27; each start position is specified, the length of peptide is 10 amino acids, and the end position for each peptide is the start position plus nine.

| Start | Subsequence | Score |
|---|---|---|
| 1 | ENLPLRLFTF | 1.000 |
| 2 | NLPLRLFTFW | 0.500 |
| 6 | RLFTFWRGPV | 0.400 |
| 8 | FTFWRGPVVV | 0.200 |
| 3 | LPLRLFTFWR | 0.200 |
| 10 | FWRGPVVVAI | 0.120 |
| 7 | LFTFWRGPVV | 0.020 |
| 9 | TFWRGPVVVA | 0.010 |
| 4 | PLRLFTFWRG | 0.003 |
| 5 | LRLFTFWRGP | 0.001 |

TABLE XXI

V21-HLA-B35-10mers-98P4B6
Each peptide is a portion of SEQ ID NO: 43; each start position is specified, the length of peptide is 10 amino acids, and the end position for each peptide is the start position plus nine.

| Start | Subsequence | Score |
|---|---|---|
| 9 | KTKHCMFSLI | 2.400 |
| 1 | LSKLTQEQKT | 1.500 |
| 5 | TQEQKTKHCM | 0.600 |
| 7 | EQKTKHCMFS | 0.300 |
| 4 | LTQEQKTKHC | 0.200 |
| 6 | QEQKTKHCMF | 0.100 |
| 8 | QKTKHCMFSL | 0.100 |

TABLE XXI-continued

V21-HLA-B35-10mers-98P4B6
Each peptide is a portion of SEQ ID NO: 43; each start position is specified, the length of peptide is 10 amino acids, and the end position for each peptide is the start position plus nine.

| Start | Subsequence | Score |
|---|---|---|
| 3 | KLTQEQKTKH | 0.020 |
| 10 | TKHCMFSLIS | 0.010 |
| 2 | SKLTQEQKTK | 0.002 |

TABLE XXI

V25-HLA-B35-10mers-98P4B6
Each peptide is a portion of SEQ ID NO: 51; each start position is specified, the length of peptide is 10 amino acids, and the end position for each peptide is the start position plus nine.

| Start | Subsequence | Score |
|---|---|---|
| 5 | LPCISQKLKR | 0.200 |
| 3 | LFLPCISQKL | 0.100 |
| 8 | ISQKLKRIKK | 0.050 |
| 10 | QKLKRIKKGW | 0.050 |
| 6 | PCISQKLKRI | 0.040 |
| 9 | SQKLKRIKKG | 0.030 |
| 4 | FLPCISQKLK | 0.010 |
| 7 | CISQKLKRIK | 0.010 |
| 2 | ILFLPCISQK | 0.010 |
| 1 | IILFIPCISQ | 0.010 |

TABLE XXII

V1-HLA-A1-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 158 | PKDASRQVY | 27 |
| 419 | FEEEYYRFY | 27 |
| 405 | ISTFHVLIY | 26 |
| 221 | SLATFEFLY | 23 |
| 263 | AITLLSLVY | 23 |
| 392 | SEIQSTLGY | 23 |
| 276 | LAAAYQLYY | 22 |
| 280 | YQLYYGTKY | 21 |

TABLE XXII-continued

V1-HLA-A1-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 244 | QSDFYKIPI | 19 |
| 101 | LWDLRHLLV | 18 |
| 189 | PIDLGSLSS | 18 |
| 198 | AREIENLPL | 18 |
| 231 | FVRDVIIPY | 18 |
| 240 | ARNQQSDFY | 18 |
| 275 | LLAAAYQLY | 18 |
| 311 | FFAMVHVAY | 18 |
| 90 | FVAIHREHY | 17 |
| 117 | SNNMRINQY | 17 |
| 327 | RSERYLFLN | 17 |
| 388 | WREFSFIQS | 17 |
| 427 | YTPPNFVLA | 17 |
| 443 | ILDLLQLCR | 17 |
| 444 | LDLLQLCRY | 17 |
| 46 | TIRLIRCGY | 16 |
| 66 | ASEFFPHVV | 16 |
| 124 | QYPESNAEY | 16 |
| 200 | EIENLPLRI | 16 |
| 330 | RYLFLNMAY | 16 |
| 352 | EEVWRIEMY | 16 |
| 272 | LAGLLAAAY | 15 |
| 323 | LPMRRSERY | 15 |
| 351 | EEEVWRIEM | 15 |
| 415 | WKRAFEEEY | 15 |
| 416 | KRAFEEEYY | 15 |
| 13 | LSETCLPNG | 14 |
| 38 | SGDFAKSLT | 14 |
| 98 | YTSLWDLRH | 14 |
| 178 | VIELARQLN | 14 |
| 406 | STFHVLIYG | 14 |
| 94 | HREHYTSLW | 13 |
| 135 | SLFPDSLIV | 13 |
| 137 | FPDSLIVKG | 13 |

TABLE XXII-continued

V1-HLA-A1-9mers-98P4B6
Each peptide is a portion of SEQ ID NO: 3;
each start position is specified, the
length of peptide is 9 amino acids, and the
end position for each peptide is the start
position plus eight.

| Pos | 123456789 | score |
|---|---|---|
| 251 | PIEIVNKTL | 13 |
| 396 | STLGYVALL | 13 |

TABLE XXII

V2-HLA-A1-9mers-98P4B6
Each peptide is a portion of SEQ ID NO: 5;
each start position is specified, the
length of peptide is 9 amino acids, and the
end position for each peptide is the start
position plus eight.

| Pos | 123456789 | score |
|---|---|---|
| 23 | LSLPSSWDY | 23 |
| 36 | PCPADFFLY | 20 |
| 17 | FTPFSCLSL | 13 |
| 28 | SWDYRCPPP | 12 |

TABLE XXII

V5A-HLA-A1-9mers-98P4B6
Each peptide is a portion of SEQ ID NO: 11;
each start position is specified, the
length of peptide is 9 amino acids, and the
end position for each peptide is the start
position plus eight.

| Pos | 123456789 | score |
|---|---|---|
| 7 | FTFWRGPVV | 9 |
| 9 | FWRGPVVVA | 5 |

TABLE XXII

V5B-HLA-A1-9mers-98P4B6
Each peptide is a portion of SEQ ID NO: 11;
each start position is specified, the
length of peptide is 9 amino acids, and the
end position for each peptide is the start
position plus eight.

| Pos | 123456789 | score |
|---|---|---|
| 21 | ELEFVELLT | 24 |
| 1 | WREFSFIQI | 17 |
| 17 | QTELELEFV | 16 |
| 13 | FADTQTELE | 15 |
| 19 | ELELEFVFL | 14 |

TABLE XXII

V6-HLA-A1-9mers-98P4B6
Each peptide is a portion of SEQ ID NO: 13;
each start position is specified, the
length of peptide is 9 amino acids, and the
end position for each peptide is the start
position plus eight.

| Pos | 123456789 | score |
|---|---|---|
| 34 | FLEEGIGGT | 14 |
| 28 | GWEKSQFLE | 12 |
| 35 | LEEGIGGTI | 12 |
| 29 | WEKSQFLEE | 11 |
| 41 | GTIPHVSPE | 11 |
| 1 | VLPSIVILG | 9 |
| 9 | GKIILFLPC | 9 |
| 19 | SRKLKRIKK | 9 |
| 20 | LPSIVILGK | 8 |
| 6 | VILGKIILF | 8 |
| 16 | PCISRKLKR | 8 |
| 7 | ILGKIILFL | 7 |
| 37 | EGIGGTIPH | 7 |
| 46 | VSPERVTVM | 7 |
| 3 | PSIVILGKI | 6 |
| 5 | IVILGKIIL | 6 |
| 12 | ILFLPCISR | 6 |

TABLE XXII

V7A-HLA-A1-9mers-98P4B6
Each peptide is a portion of SEQ ID NO: 15;
each start position is specified, the
length of peptide is 9 amino acids, and the
end position for each peptide is the start
position plus eight.

| Pos | 123456789 | score |
|---|---|---|
| 5 | LSETFLPNG | 14 |
| 4 | SLSETFLPN | 12 |
| 8 | TFLPNGING | 9 |
| 7 | ETFLPNGIN | 8 |
| 3 | KSLSETFLP | 6 |

TABLE XXII

V7B-HLA-A1-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 5 | AYQQSTLGY | 22 |
| 9 | STLGYVALL | 13 |

TABLE XXII

V7C-HLA-A1-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 59 | WTEEAGATA | 17 |
| 90 | VTEDDEAQD | 17 |
| 99 | SIDPPESPD | 17 |
| 167 | KLETIILSK | 17 |
| 32 | LSEIVLPIE | 16 |
| 51 | STPPPPAMW | 14 |
| 154 | WSLGEFLGS | 14 |
| 5 | ILDLSVEVL | 13 |
| 69 | AQESGIRNK | 13 |
| 9 | SVEVLASPA | 12 |
| 38 | PIEWQQDRK | 12 |
| 60 | TEEAGATAE | 12 |
| 66 | TAEAQESGI | 12 |
| 93 | DDEAQDSID | 12 |
| 104 | ESPDRALKA | 12 |
| 105 | SPDRALKAA | 12 |
| 123 | HTNGVGPLW | 12 |
| 130 | LWEFLLRLL | 12 |
| 96 | AQDSIDPPE | 11 |
| 102 | PPESPDRAL | 11 |
| 128 | GPLWEFLLR | 11 |
| 143 | ASGTLSLAF | 11 |
| 156 | LGEFLGSGT | 11 |
| 42 | QQDRKIPPL | 10 |
| 78 | SSSSSQIPV | 10 |
| 82 | SQIPVVGVV | 10 |

TABLE XXII-continued

V7C-HLA-A1-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 91 | TEDDEAQDS | 10 |
| 92 | EDDEAQDSI | 10 |
| 115 | SWRNPVLPH | 10 |
| 176 | LTQEQKSKH | 10 |
| 177 | TQEQKSKHC | 10 |
| 26 | NILRGGLSE | 9 |
| 50 | LSTPPPPAM | 9 |
| 79 | SSSSQIPVV | 9 |
| 131 | WEFLLRLLK | 9 |
| 2 | SIVILDLSV | 8 |
| 7 | DLSVEVLAS | 8 |
| 21 | KCLGANILR | 8 |
| 31 | GLSEIVLPI | 8 |
| 81 | SSQIPVVGV | 8 |
| 124 | TNGVGPLWE | 8 |
| 132 | EFLLRLLKS | 8 |
| 141 | QAASGTLSL | 8 |
| 162 | SGTWMKLET | 8 |
| 169 | ETIILSKLT | 8 |

TABLE XXII

V8-HLA-A1-9mers-98P4B6
Each peptide is a portion of SEQ ID NO: 17; each start position is specified, the length of peptide is 9 amino acids, and the end position for each peptide is the start position plus eight.

| Pos | 123456789 | score |
|---|---|---|
| 4 | FLEEGMGGT | 14 |
| 5 | LEEGMGGTI | 12 |
| 7 | EGMGGTIPH | 7 |

TABLE XXII

V13-HLA-A1-9mers-98P4B6
Each peptide is a portion of SEQ ID NO: 27; each start position is specified, the length of peptide is 9 amino acids, and the end position for each peptide is the start position plus eight.

| Pos | 123456789 | score |
|---|---|---|
| 5 | LSETFLPNG | 14 |
| 4 | SLSETFLPN | 12 |
| 8 | TFLPNGING | 9 |
| 7 | ETFLPNGIN | 8 |
| 3 | KSLSETFLP | 6 |

TABLE XXII

V14-HLA-A1-9mers-98P4B6
Each peptide is a portion of SEQ ID NO: 29; each start position is specified, the length of peptide is 9 amino acids, and the end position for each peptide is the start position plus eight.

| Pos | 123456789 | score |
|---|---|---|
| 7 | FTFWRGPVV | 9 |
| 9 | FWRGPVVVA | 5 |

TABLE XXII

V21-HLA-A1-9mers-98P4B6
Each peptide is a portion of SEQ ID NO: 43; each start position is specified, the length of peptide is 9 amino acids, and the end position for each peptide is the start position plus eight.

| Pos | 123456789 | score |
|---|---|---|
| 3 | LTQEQKTKH | 10 |
| 4 | TQEQKTKHC | 10 |
| 1 | SKLTQEQKT | 6 |
| 8 | KTKHCMFSL | 6 |
| 9 | TKHCMFSLI | 5 |

TABLE XXII

V25-HLA-A1-9mers-98P4B6
Each peptide is a portion of SEQ ID NO: 51; each start position is specified, the length of peptide is 9 amino acids, and the end position for each peptide is the start position plus eight.

| Pos | 123456789 | score |
|---|---|---|
| 5 | PCISQKLKR | 10 |
| 8 | SQKLKRIKK | 9 |
| 1 | ILFLPCISQ | 6 |

TABLE XXII-continued

V25-HLA-A1-9mers-98P4B6
Each peptide is a portion of SEQ ID NO: 51; each start position is specified, the length of peptide is 9 amino acids, and the end position for each peptide is the start position plus eight.

| Pos | 123456789 | score |
|---|---|---|
| 2 | LFLPCISQK | 4 |
| 3 | FLPCISQKL | 4 |
| 7 | ISQKLKRIK | 4 |

TABLE XXIII

V1-HLA-A0201-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 365 | IMSLGLLSL | 29 |
| 271 | YLAGLLAAA | 28 |
| 433 | VLALVLPSI | 28 |
| 227 | FLYSFVRDV | 27 |
| 360 | YISFGIMSL | 27 |
| 396 | STLGYVALL | 27 |
| 17 | CLPNGINGI | 26 |
| 100 | SLWDLRHLL | 26 |
| 135 | SLFPDSLIV | 26 |
| 203 | NLPRLFTL | 26 |
| 402 | ALLISTFHV | 26 |
| 436 | LVLPSIVIL | 26 |
| 128 | SNAEYLASL | 25 |
| 140 | SLIVKGENV | 25 |
| 187 | FIPIDLGSL | 25 |
| 210 | TLWRGPVVV | 25 |
| 261 | IVAITLLSL | 25 |
| 403 | LLISTFHVL | 25 |
| 5 | SMMGSPKSL | 24 |
| 264 | ITLLSLVYL | 24 |
| 274 | GLLAAAYQL | 24 |
| 307 | LLSFFFAMV | 24 |
| 369 | GLLSLLAVT | 24 |
| 48 | RLIRCGYHV | 23 |
| 49 | LIRCGYHVV | 23 |

TABLE XXIII-continued

V1-HLA-A0201-9mers-98P4B6
Each peptide is a portion of SEQ ID NO: 3;
each start position is specified, the
length of peptide is 9 amino acids, and the
end position for each peptide is the start
position plus eight.

| Pos | 123456789 | score |
|---|---|---|
| 141 | LIVKGFNVV | 23 |
| 313 | AMVHVAYSL | 23 |
| 374 | LAVTSIPSV | 23 |
| 393 | FIQSTLGYV | 23 |
| 441 | IVILDLLQL | 23 |
| 106 | HLLVGKILI | 22 |
| 180 | ELARQLNFI | 22 |
| 254 | IVNKTLPIV | 22 |
| 258 | TLPIVAITL | 22 |
| 262 | VAITLLSLV | 22 |
| 265 | TLLSLVYLA | 22 |
| 267 | LSLVYLAGL | 22 |
| 268 | SLVYLAGLL | 22 |
| 333 | FLNMAYQQV | 22 |
| 378 | SIPSVSNAL | 22 |
| 404 | LISTFHVLI | 21 |
| 435 | ALVLPSIVI | 21 |
| 107 | LLVGKILID | 20 |
| 108 | LVGKILIDV | 20 |
| 112 | ILIDVSNNM | 20 |
| 173 | QARQQVIEL | 20 |
| 184 | QLNFIPIDL | 20 |
| 368 | LGLLSLLAV | 20 |
| 65 | FASEFFPHV | 19 |
| 83 | LTKTNIIFV | 19 |
| 133 | LASLFPDSL | 19 |
| 177 | QVIELARQL | 19 |
| 257 | KTLPIVAIT | 19 |
| 306 | GLLSFFFAM | 19 |
| 366 | MSLGLLSLL | 19 |
| 434 | LALVLPSIV | 19 |
| 27 | DARKVTVGV | 18 |
| 196 | SSAREIENL | 18 |
| 209 | FTLWRGPVV | 18 |
| 259 | LPIVAITLL | 18 |

TABLE XXIII-continued

V1-HLA-A0201-9mers-98P4B6
Each peptide is a portion of SEQ ID NO: 3;
each start position is specified, the
length of peptide is 9 amino acids, and the
end position for each peptide is the start
position plus eight.

| Pos | 123456789 | score |
|---|---|---|
| 367 | SLGLLSLLA | 18 |
| 371 | LSLLAVTSI | 18 |
| 397 | TLGYVALLI | 18 |
| 41 | FAKSLTIRL | 17 |
| 81 | DALTKTNII | 17 |
| 85 | KTNIIFVAI | 17 |
| 103 | DLRHLLVGK | 17 |
| 104 | LRHLLVGKI | 17 |
| 153 | ALQLGPKDA | 17 |
| 155 | QLGPKDASR | 17 |
| 212 | WRGPVVAI | 17 |
| 250 | IPIEIVNKT | 17 |
| 253 | EIVNKTLPI | 17 |
| 363 | FGIMSLGLL | 17 |
| 370 | LLSLLAVTS | 17 |
| 410 | VLIYGWKRA | 17 |
| 428 | TPPNFVLAL | 17 |
| 438 | LPSIVILDL | 17 |
| 442 | VILDLLQLC | 17 |
| 25 | IKDARKVTV | 16 |
| 68 | EFFPHVVDV | 16 |
| 88 | IIFVAIHRE | 16 |
| 93 | IHREHYTSL | 16 |
| 99 | TSLWDLRHL | 16 |
| 132 | YLASLFPDS | 16 |
| 148 | VVSAWALQL | 16 |
| 171 | NIQARQQVI | 16 |
| 190 | IDLGSLSSA | 16 |
| 200 | EIENLPLRL | 16 |
| 372 | SLLAVTSIP | 16 |
| 12 | SLSETCLPN | 15 |
| 44 | SLTIRIIRC | 15 |
| 50 | IRCGYHVVI | 15 |
| 111 | KILIDVSNN | 15 |
| 211 | LWRGPVVA | 15 |

TABLE XXIII-continued

V1-HLA-A0201-9mers-98P4B6
Each peptide is a portion of SEQ ID NO: 3;
each start position is specified, the
length of peptide is 9 amino acids, and the
end position for each peptide is the start
position plus eight.

| Pos | 123456789 | score |
|---|---|---|
| 217 | VVAISLATF | 15 |
| 221 | SLATFFFLY | 15 |
| 247 | FYKIPIEIV | 15 |
| 249 | KIPIEIVNK | 15 |
| 251 | PIEIVNKTL | 15 |
| 256 | NKTLPIVAI | 15 |
| 270 | VYLAGLLAA | 15 |
| 299 | LQCRKQLGL | 15 |
| 324 | PMRRSERYL | 15 |
| 331 | YLFLNMAYQ | 15 |
| 335 | NMAYQQVHA | 15 |
| 385 | ALNWREFSF | 15 |
| 400 | YVALLISTF | 15 |
| 437 | VLPSIVILD | 15 |
| 23 | NGIKDARKV | 14 |
| 37 | GSGDFAKSL | 14 |
| 39 | GDFAKSLTI | 14 |
| 42 | AKSLTIRII | 14 |
| 164 | QVYICSNNI | 14 |
| 166 | YICSNNIQA | 14 |
| 220 | ISLATFFFL | 14 |
| 223 | ATFFFLYSF | 14 |
| 266 | LLSLVYLAG | 14 |
| 275 | LLAAAYQLY | 14 |
| 278 | AAYQLYYGT | 14 |
| 300 | QCRKQLGLL | 14 |
| 309 | SFFFAMVHV | 14 |
| 362 | SFGIMSLGL | 14 |
| 373 | LLAVTSIPS | 14 |
| 395 | QSTLGYVAL | 14 |
| 411 | LIYGWKRAF | 14 |
| 427 | YTPPNFVLA | 14 |
| 443 | ILDLLQLCR | 14 |

TABLE XXIII

V2-HLA-A0201-9mers-98P4B6
Each peptide is a portion of SEQ ID NO: 5;
each start position is specified, the
length of peptide is 9 amino acids, and the
end position for each peptide is the start
position plus eight.

| Pos | 123456789 | score |
|---|---|---|
| 5 | GLQALSLSL | 25 |
| 1 | SGSPGLQAL | 21 |
| 8 | ALSLSLSSG | 18 |
| 17 | FTPFSCLSL | 17 |
| 10 | SLSLSSGFT | 16 |
| 3 | SPGLQALSL | 15 |
| 12 | SLSSGFTPF | 14 |
| 15 | SGFTPFSGL | 14 |
| 24 | SLPSSWDYR | 12 |

TABLE XXIII

V5A-HLA-A0201-9mers-98P4B6
Each peptide is a portion of SEQ ID NO: 11;
each start position is specified, the
length of peptide is 9 amino acids, and the
end position for each peptide is the start
position plus eight.

| Pos | 123456789 | score |
|---|---|---|
| 7 | FTFWRGPVV | 17 |
| 1 | NLPLRLFTF | 16 |
| 8 | TFWRGPVVV | 15 |
| 9 | FWRGPVVVA | 14 |
| 5 | RLFTFWRGP | 13 |
| 3 | PLRLFTFWR | 10 |
| 6 | LFTFWRGPV | 10 |

TABLE XXIII

V5B-HLA-A0201-9mers-98P4B6
Each peptide is a portion of SEQ ID NO: 11;
each start position is specified, the
length of peptide is 9 amino acids, and the
end position for each peptide is the start
position plus eight.

| Pos | 123456789 | score |
|---|---|---|
| 20 | LELEFVFLL | 21 |
| 22 | LEFVFLLTL | 21 |
| 24 | FVFLLTLLL | 20 |
| 19 | ELELEFVFL | 18 |
| 12 | SFADTQTEL | 17 |
| 17 | QTELELEFV | 17 |
| 8 | QIFCSFADT | 15 |

TABLE XXIII-continued

V5B-HLA-A0201-9mers-98P4B6
Each peptide is a portion of SEQ ID NO: 11;
each start position is specified, the
length of peptide is 9 amino acids, and the
end position for each peptide is the start
position plus eight.

| Pos | 123456789 | score |
|---|---|---|
| 6 | FIQIFCSFA | 14 |
| 14 | ADTQTELEL | 14 |
| 23 | EFVFLLTLL | 11 |
| 21 | ELEFVFLLT | 10 |

TABLE XXIII

V6-HLA-A0201-9mers-98P4B6
Each peptide is a portion of SEQ ID NO: 11;
each start position is specified, the
length of peptide is 9 amino acids, and the
end position for each peptide is the start
position plus eight.

| Pos | 123456789 | score |
|---|---|---|
| 7 | ILGKIILFL | 27 |
| 38 | GIGGTIPHV | 26 |
| 10 | KIILFLPCI | 25 |
| 14 | FLPCISRKL | 23 |
| 34 | FLEEGIGGT | 23 |
| 5 | IVILGKIIL | 20 |
| 17 | CISRKLKRI | 20 |
| 45 | HVSPERVTV | 20 |
| 4 | SIVILGKII | 18 |
| 6 | VILGKIILF | 18 |
| 12 | ILFLPCISR | 16 |
| 1 | VLPSIVILG | 15 |
| 27 | KGWEKSQFL | 15 |
| 3 | PSIVILGKI | 13 |
| 35 | LEEGIGGTI | 13 |
| 41 | GTIPHVSPE | 13 |

TABLE XXIII

V7A-HLA-A0201-9mers-98P4B6
Each peptide is a portion of SEQ ID NO: 15; each
start position is specified, the length of peptide
is 9 amino acids, and the end position for each
peptide is the start position plus eight.

| Pos | 123456789 | score |
|---|---|---|
| 9 | FLPNGINGI | 27 |
| 4 | SLSETFLPN | 15 |

TABLE XXIII

V7B-HLA-A0201-9mers-98P4B6
Each peptide is a portion of SEQ ID NO: 15; each
start position is specified, the length of peptide
is 9 amino acids, and the end position for each
peptide is the start position plus eight.

| Pos | 123456789 | score |
|---|---|---|
| 9 | STLGYVALL | 27 |
| 3 | NMAYQQSTL | 21 |
| 6 | YQQSTLGYV | 16 |
| 8 | QSTLGYVAL | 14 |

TABLE XXIII

V7C-HLA-A0201-9mers-98P4B6
Each peptide is a portion of SEQ ID NO: 15; each
start position is specified, the length of peptide
is 9 amino acids, and the end position for each
peptide is the start position plus eight.

| Pos | 123456789 | score |
|---|---|---|
| 27 | ILRGGLSEI | 30 |
| 4 | VILDLSVEV | 27 |
| 5 | ILDLSVEVL | 26 |
| 31 | GLSEIVLPI | 26 |
| 129 | PLWEFLLRL | 26 |
| 148 | SLAFTSWSL | 25 |
| 2 | SIVILDLSV | 24 |
| 141 | QAASGTLSL | 23 |
| 155 | SLGEFLGSG | 21 |
| 163 | GTWMKLETI | 21 |
| 81 | SSQIPVVGV | 20 |
| 82 | SQIPVVGVV | 20 |
| 119 | PVLPHTNGV | 19 |
| 133 | FLLRLLKSQ | 19 |
| 165 | WMKLETIIL | 19 |
| 24 | GANILRGGL | 18 |
| 57 | AMWTEEAGA | 18 |
| 112 | AANSWRNPV | 18 |
| 126 | GVGPLWEFL | 18 |
| 12 | VLASPAAAW | 17 |
| 79 | SSSSQPIVV | 17 |
| 134 | LLRLLKSQA | 17 |
| 167 | KLETIILSK | 17 |
| 168 | LETIILSKL | 17 |
| 171 | IILSKLTQE | 17 |

TABLE XXIII-continued

V7C-HLA-A0201-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 172 | ILSKLTQEQ | 17 |
| 42 | QQDRKIPPL | 16 |
| 142 | AASGTLSLA | 16 |
| 160 | LGSGTWMKL | 16 |
| 7 | DLSVEVLAS | 15 |
| 17 | AAAWKCLGA | 15 |
| 22 | CLGANILRG | 15 |
| 26 | NILRGGLSE | 15 |
| 28 | LRGGLSEIV | 15 |
| 130 | LWEFLLRLL | 15 |
| 136 | RLLKSQAAS | 15 |
| 137 | LLKSQAASG | 15 |
| 159 | FLGSGTWMK | 15 |
| 185 | CMFSLISGS | 15 |
| 83 | QIPVVGVVT | 14 |

TABLE XXIII

V8-HLA-A0201-9mers-98P4B6
Each peptide is a portion of SEQ ID NO: 17; each start position is specified, the length of peptide is 9 amino acids, and the end position for each peptide is the start position plus eight.

| Pos | 123456789 | score |
|---|---|---|
| 8 | GMGGTIPHV | 26 |
| 4 | FLEEGMGGT | 19 |
| 5 | LEEGMGGTI | 13 |

TABLE XXIII

V13-HLA-A0201-9mers-98P4B6
Each peptide is a portion of SEQ ID NO: 27; each start position is specified, the length of peptide is 9 amino acids, and the end position for each peptide is the start position plus eight.

| Pos | 123456789 | score |
|---|---|---|
| 9 | FLPNGINGI | 27 |
| 4 | SLSETFLPN | 15 |

TABLE XXIII

V14-HLA-A0201-9mers-98P4B6
Each peptide is a portion of SEQ ID NO: 29; each start position is specified, the length of peptide is 9 amino acids, and the end position for each peptide is the start position plus eight.

| Pos | 123456789 | score |
|---|---|---|
| 7 | FTFWRGPVV | 17 |
| 1 | NLPLRLFTF | 16 |
| 8 | TFWRGPVVV | 15 |
| 9 | FWRGPVVVA | 14 |
| 5 | RLFTFWRGP | 13 |
| 3 | PLRLFTFWR | 10 |
| 6 | LFTFWRGPV | 10 |

TABLE XXIII

V21-HLA-A0201-9mers-98P4B6
Each peptide is a portion of SEQ ID NO: 43; each start position is specified, the length of peptide is 9 amino acids, and the end position for each peptide is the start position plus eight.

| Pos | 123456789 | score |
|---|---|---|
| 8 | KTKHCMFSL | 16 |
| 2 | KLTQEQKTK | 11 |
| 1 | SKLTQEQKT | 10 |
| 3 | LTQEQKTKH | 10 |
| 9 | TKHCMFSLI | 8 |

TABLE XXIII

V25-HLA-A0201-9mers-98P4B6
Each peptide is a portion of SEQ ID NO: 51; each start position is specified, the length of peptide is 9 amino acids, and the end position for each peptide is the start position plus eight.

| Pos | 123456789 | score |
|---|---|---|
| 3 | FLPCISQKL | 23 |
| 6 | CISQKLKRI | 20 |
| 1 | ILFLPCISQ | 16 |

TABLE XXIV

V1-HLA-A0203-9mers-98P4B6

| Pos | 123456789 | score |
|---|---|---|
| | NoResultsFound. | |

TABLE XXIV

V2-HLA-A0203-9mers-98P4B6

| Pos | 123456789 | score |
|---|---|---|
| NoResultsFound. | | |

TABLE XXIV

V5A-HLA-A0203-9mers-98P4B6

| Pos | 123456789 | score |
|---|---|---|
| NoResultsFound. | | |

TABLE XXIV

V5B-HLA-A0203-9mers-98P4B6

| Pos | 123456789 | score |
|---|---|---|
| NoResultsFound. | | |

TABLE XXIV

V6-HLA-A0203-9mers-98P4B6

| Pos | 123456789 | score |
|---|---|---|
| NoResultsFound. | | |

TABLE XXIV

V7A-HLA-A0203-9mers-98P4B6

| Pos | 123456789 | score |
|---|---|---|
| NoResultsFound. | | |

TABLE XXIV

V7B-HLA-A0203-9mers-98P4B6

| Pos | 123456789 | score |
|---|---|---|
| NoResultsFound. | | |

TABLE XXIV

V7C-HLA-A0203-9mers-98P4B6

| Pos | 123456789 | score |
|---|---|---|
| NoResultsFound. | | |

TABLE XXIV

V8-HLA-A0203-9mers-98P4B6

| Pos | 123456789 | score |
|---|---|---|
| NoResultsFound. | | |

TABLE XXIV

V13-HLA-A0203-9mers-98P4B6

| Pos | 123456789 | score |
|---|---|---|
| NoResultsFound. | | |

TABLE XXIV

V14-HLA-A0203-9mers-98P4B6

| Pos | 123456789 | score |
|---|---|---|
| NoResultsFound. | | |

TABLE XXIV

V21-HLA-A0203-9mers-98P4B6

| Pos | 123456789 | score |
|---|---|---|
| No Results Found. | | |

TABLE XXIV

V25-HLA-A0203-9mers-98P4B6

| Pos | 123456789 | score |
|---|---|---|
| No Results Found. | | |

TABLE XXV

V1-HLA-A3-9mers-98P4B6

Each peptide is a portion of SEQ ID NO: 3; each start position is specified, the length of peptide is 9 amino acids, and the end position for each peptide is the start position plus eight.

| Pos | 123456789 | score |
|---|---|---|
| 103 | DLRHLLVGK | 27 |
| 56 | VVIGSRNPK | 26 |
| 249 | KIPIEIVNK | 26 |
| 3 | SISMMGSPK | 25 |
| 155 | QLGPKDASR | 25 |
| 263 | AITLLSLVY | 25 |
| 210 | TLWRGPVVV | 24 |
| 48 | RLIRCGYHV | 23 |
| 142 | IVKGFNVVS | 23 |
| 217 | VVAISLATF | 23 |
| 400 | YVALLISTF | 23 |
| 177 | QVIELARQL | 22 |

TABLE XXV-continued

V1-HLA-A3-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|---|---|---|
| 205 | PLRLFTLWR | 22 |
| 281 | QLYYGTKYR | 22 |
| 370 | LLSLLAVTS | 22 |
| 441 | IVILDLLQL | 22 |
| 35 | VIGSGDFAK | 21 |
| 77 | THHEDALTK | 21 |
| 148 | VVSAWALQL | 21 |
| 231 | FVRDVIHPY | 21 |
| 269 | LVYLAGLLA | 21 |
| 375 | AVTSIPSVS | 21 |
| 385 | ALNWREFSF | 21 |
| 274 | GLLAAAYQL | 20 |
| 322 | CLPMRRSER | 20 |
| 409 | HVLIYGWKR | 20 |
| 443 | ILDLLQLCR | 20 |
| 46 | TIRLIRCGY | 19 |
| 87 | NIIFVAIHR | 19 |
| 90 | FVAIHREHY | 19 |
| 258 | TLPIVAITL | 19 |
| 261 | IVAITLLSL | 19 |
| 275 | LLAAAYQLY | 19 |
| 279 | AYQLYYGTK | 19 |
| 369 | GLLSLLAVT | 19 |
| 372 | SLLAVTSIP | 19 |
| 411 | LIYGWKRAF | 19 |
| 436 | LVLPSIVIL | 19 |
| 34 | GVIGSGDFA | 18 |
| 92 | AIHREHYTS | 18 |
| 140 | SLIVKGFNV | 18 |
| 191 | DLGSLSSAR | 18 |
| 221 | SLATFFFLY | 18 |
| 435 | ALVLPSIVI | 18 |
| 22 | INGIKDARK | 17 |
| 49 | LIRCGYHVV | 17 |

TABLE XXV-continued

V1-HLA-A3-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|---|---|---|
| 82 | ALTKTNIIF | 17 |
| 111 | KILIDVSNN | 17 |
| 112 | ILIDVSNNM | 17 |
| 135 | SLFPDSLIV | 17 |
| 153 | ALQLGPKDA | 17 |
| 164 | QVYICSNNI | 17 |
| 203 | NLPLRLFTL | 17 |
| 271 | YLAGLLAAA | 17 |
| 304 | QLGLLSFFF | 17 |
| 381 | SVSNALNWR | 17 |
| 397 | TLGYVALLI | 17 |
| 403 | LLISTFHVL | 17 |
| 432 | FVLALVLPS | 17 |
| 32 | TVGVIGSGD | 16 |
| 107 | LLVGKILID | 16 |
| 151 | AWALQLGPK | 16 |
| 171 | NIQARQQVI | 16 |
| 189 | PIDLGSLSS | 16 |
| 216 | VVVAISLAT | 16 |
| 219 | AISLATFFF | 16 |
| 234 | DVIHPYARN | 16 |
| 266 | LLSLVYLAG | 16 |
| 302 | RKQLGLLSF | 16 |
| 402 | ALLISTFHV | 16 |
| 12 | SLSETCLPN | 15 |
| 21 | GINGIKDAR | 15 |
| 24 | GIKDARKVT | 15 |
| 30 | KVTVGVIGS | 15 |
| 121 | RINQYPESN | 15 |
| 136 | LFPDSLIVK | 15 |
| 179 | IELARQLNF | 15 |
| 268 | SLVYLAGLL | 15 |
| 356 | RIEMYISFG | 15 |

TABLE XXV-continued

V1-HLA-A3-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 367 | SLGLLSLLA | 15 |
| 410 | VLIYGWKRA | 15 |
| 433 | VLALVLPSI | 15 |
| 25 | IKDARKVTV | 14 |
| 44 | SLTIRLIRC | 14 |
| 57 | VIGSRNPKF | 14 |
| 61 | RNPKFASEF | 14 |
| 106 | HLLVGKILI | 14 |
| 141 | LIVKGFNVV | 14 |
| 180 | ELARQLNFI | 14 |

TABLE XXV

V1-HLA-A3-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 207 | RLFTLWRGP | 14 |
| 227 | FLYSFVRDV | 14 |
| 235 | VIHPYARNQ | 14 |
| 241 | RNQQSDFYK | 14 |
| 251 | PIEIVNKTL | 14 |
| 272 | LAGLLAAAY | 14 |
| 294 | WLETWLQCR | 14 |
| 303 | KQLGLLSFF | 14 |
| 307 | LLSFFFAMV | 14 |
| 330 | RYLFLNMAY | 14 |
| 331 | YLFLNMAYQ | 14 |
| 340 | QVHANIENS | 14 |
| 353 | EVWRIEMYI | 14 |
| 364 | GIMSLGLLS | 14 |
| 17 | CLPNGINGI | 13 |

TABLE XXV-continued

V1-HLA-A3-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 18 | LPNGINGIK | 13 |
| 26 | KDARKVTVG | 13 |
| 43 | KSLTIRLIR | 13 |
| 55 | HVVIGSRNP | 13 |
| 70 | FPHVVDVTH | 13 |
| 100 | SLWDLRHLL | 13 |
| 113 | LIDVSNNMR | 13 |
| 147 | NVVSAWALQ | 13 |
| 158 | PKDASRQVY | 13 |
| 184 | QLNFIPIDL | 13 |
| 200 | EIENLPLRL | 13 |
| 211 | LWRGPVVVA | 13 |
| 215 | PVVVAISLA | 13 |
| 253 | EIVNKTLPI | 13 |
| 260 | PIVAITLLS | 13 |
| 306 | GLLSFFFAM | 13 |
| 311 | FFAMVHVAY | 13 |
| 314 | MVHVAYSLC | 13 |
| 333 | FLNMAYQQV | 13 |
| 360 | YISFGIMSL | 13 |
| 392 | SFIQSTLGY | 13 |
| 408 | FHVLIYGWK | 13 |
| 440 | SIVILDLLQ | 13 |

TABLE XXV

V2-HLA-A3-9mers-98P4B6
Each peptide is a portion of SEQ ID NO: 5; each start position is specified, the length of peptide is 9 amino acids, and the end position for each peptide is the start position plus eight.

| Pos | 123456789 | score |
|---|---|---|
| 8 | ALSLSLSSG | 19 |
| 12 | SLSSGFTPE | 18 |
| 5 | GLQALSLSL | 17 |
| 22 | CLSLPSSWD | 15 |

TABLE XXV-continued

V2-HLA-A3-9mers-98P4B6
Each peptide is a portion of SEQ ID NO: 5; each start position is specified, the length of peptide is 9 amino acids, and the end position for each peptide is the start position plus eight.

| Pos | 123456789 | score |
|---|---|---|
| 24 | SLPSSWDYR | 15 |
| 10 | SLSLSSGFT | 13 |
| 23 | LSLPSSWDY | 11 |
| 33 | CPPPCPADF | 11 |
| 3 | SPGLQALSL | 10 |
| 7 | QALSLSLSS | 9 |
| 9 | LSLSLSSGF | 9 |
| 11 | LSLSSGFTP | 9 |
| 21 | SCLSLPSSW | 9 |
| 37 | CPADFFLYF | 9 |

TABLE XXV

V5A-HLA-A3-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 1 | NLPLRLFTF | 21 |
| 3 | PLRLFTFWR | 19 |
| 5 | RLFTFWRGP | 14 |
| 8 | TFWRGPVVV | 14 |
| 9 | FWRGPVVVA | 13 |

TABLE XXV

V5B-HLA-A3-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 19 | ELELEFVFL | 15 |
| 21 | ELEFVFLLT | 14 |
| 24 | FVFLLTLLL | 14 |
| 8 | QIFCSFADT | 13 |
| 6 | FIQIFCSFA | 12 |
| 18 | TELELEFVF | 11 |

TABLE XXV-continued

V5B-HLA-A3-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 5 | SFIQIFCSF | 10 |
| 9 | IFCSFADTQ | 9 |
| 2 | REFSFIQIF | 8 |
| 16 | TQTELELEF | 8 |
| 22 | LEFVFLLTL | 7 |

TABLE XXV

V6-HLA-A3-9mers-98P4B6
Each peptide is a portion of SEQ ID NO: 13; each start position is specified, the length of peptide is 9 amino acids, and the end position for each peptide is the start position plus eight.

| Pos | 123456789 | score |
|---|---|---|
| 45 | HVSPERVTV | 22 |
| 23 | KRIKKGWEK | 20 |
| 12 | ILFLPCISR | 19 |
| 5 | IVILGKIIL | 18 |
| 13 | LFLPCISRK | 18 |
| 6 | VILGKIILF | 17 |
| 21 | KLKRIKKGW | 17 |
| 2 | LPSIVILGK | 15 |
| 7 | ILGKIILFL | 15 |
| 10 | KIILFLPCI | 15 |
| 18 | ISRKLKRIK | 15 |
| 19 | SRKLKRIKK | 15 |
| 24 | RIKKGWEKS | 15 |
| 34 | FLEEGIGGT | 14 |
| 4 | SIVILGKII | 13 |
| 11 | IILFLPCIS | 13 |
| 26 | KKGWEKSQF | 13 |
| 42 | TIPHVSPER | 13 |
| 15 | LPCISRKLK | 12 |
| 16 | PCISRKLKR | 12 |
| 17 | CISRKLKRI | 12 |
| 37 | EGIGGTIPH | 11 |
| 1 | VLPSIVILG | 10 |
| 14 | FLPCISRKL | 10 |

TABLE XXV-continued

V6-HLA-A3-9mers-98P4B6
Each peptide is a portion of SEQ ID NO: 13; each start position is specified, the length of peptide is 9 amino acids, and the end position for each peptide is the start position plus eight.

| Pos | 123456789 | score |
|---|---|---|
| 35 | LEEGIGGTI | 10 |
| 38 | GIGGTIPHV | 10 |

TABLE XXV

V7A-HLA-A3-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 4 | SLSETFLPN | 15 |
| 9 | FLPNGINGI | 13 |
| 1 | SPKSLSETF | 10 |
| 8 | TFLPNGING | 8 |

TABLE XXV

V7B-HLA-A3-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 1 | FLNMAYQQS | 13 |
| 5 | AYQQSTLGY | 12 |
| 8 | QSTLGYVAL | 10 |
| 7 | QQSTLGYVA | 9 |
| 3 | NMAYQQSTL | 8 |
| 9 | STLGYVALL | 8 |
| 4 | MAYQQSTLG | 8 |

TABLE XXV

V7C-HLA-A3-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 167 | KLETIILSK | 28 |
| 175 | KLTQEQKSK | 25 |
| 109 | ALKAANSWR | 24 |
| 3 | IVILDLSVE | 23 |
| 26 | NILRGGLSE | 23 |
| 159 | FLGSGTWMK | 23 |
| 27 | ILRGGLSEI | 22 |
| 83 | QIPVVGVVT | 22 |
| 13 | LASPAAAWK | 20 |
| 35 | IVLPIEWQQ | 20 |
| 134 | LLRLLKSQA | 20 |
| 136 | RLLKSQAAS | 20 |
| 11 | EVLASPAAA | 19 |
| 137 | LLKSQAASG | 19 |
| 170 | TIILSKLTQ | 19 |
| 12 | VLASPAAAW | 18 |
| 38 | PIEWQQDRK | 18 |
| 73 | GIRNKSSSS | 18 |
| 5 | ILDLSVEVL | 17 |
| 9 | SVEVLASPA | 17 |
| 45 | RKIPPLSTP | 17 |
| 103 | PESPDRALK | 17 |
| 133 | FLLRLLKSQ | 17 |
| 171 | IILSKLTQE | 17 |
| 2 | SIVILDLSV | 15 |
| 4 | VILDLSVEV | 15 |
| 22 | CLGANILRG | 15 |
| 46 | KIPPLSTPP | 15 |
| 69 | AQESGIRNK | 15 |
| 99 | SIDPPESPD | 15 |
| 119 | PVLPHTNGV | 15 |
| 120 | VLPHTNGVG | 15 |
| 131 | WEFLLRLLK | 15 |
| 155 | SLGEFLGSG | 15 |

TABLE XXV-continued

V7C-HLA-A3-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 173 | LSKLTQEQK | 15 |
| 7 | DLSVEVLAS | 14 |
| 31 | GLSEIVLPI | 14 |
| 36 | VLPIEWQQD | 14 |
| 85 | PVVGVVTED | 14 |
| 129 | PLWEFLLRL | 14 |
| 146 | TLSLAFTSW | 14 |
| 148 | SLAFTSWSL | 14 |
| 25 | ANILRGGLS | 13 |
| 82 | SQIPVVGVV | 13 |
| 126 | GVGPLWEFL | 13 |

TABLE XXV

V8-HLA-A3-9mers-98P4B6
Each peptide is a portion of SEQ ID NO: 17; each start position is specified, the length of peptide is 9 amino acids, and the end position for each peptide is the start position plus eight.

| Pos | 123456789 | score |
|---|---|---|
| 4 | FLEEGMGGT | 14 |
| 5 | LEEGMGGTI | 10 |
| 3 | QFLEEGMGG | 9 |
| 7 | EGMGGTIPH | 8 |
| 6 | EEGMGGTIP | 6 |

TABLE XXV

V13-HLA-A3-9mers-98P4B6
Each peptide is a portion of SEQ ID NO: 27; each start position is specified, the length of peptide is 9 amino acids, and the end position for each peptide is the start position plus eight.

| Pos | 123456789 | score |
|---|---|---|
| 4 | SLSETFLPN | 15 |
| 9 | FLPNGINGI | 13 |

TABLE XXV-continued

V13-HLA-A3-9mers-98P4B6
Each peptide is a portion of SEQ ID NO: 27; each start position is specified, the length of peptide is 9 amino acids, and the end position for each peptide is the start position plus eight.

| Pos | 123456789 | score |
|---|---|---|
| 1 | SPKSLSETF | 10 |
| 8 | TFLPNGING | 8 |

TABLE XXV

V14-HLA-A3-9mers-98P4B6
Each peptide is a portion of SEQ ID NO: 29; each start position is specified, the length of peptide is 9 amino acids, and the end position for each peptide is the start position plus eight.

| Pos | 123456789 | score |
|---|---|---|
| 1 | NLPLRLFTF | 21 |
| 3 | PLRLFTFWR | 19 |
| 5 | RLFTFWRGP | 14 |
| 8 | TFWRGPVVV | 14 |
| 9 | FWRGPVVVA | 13 |

TABLE XXV

V21-HLA-A3-9mers-98P4B6
Each peptide is a portion of SEQ ID NO: 43; each start position is specified, the length of peptide is 9 amino acids, and the end position for each peptide is the start position plus eight.

| Pos | 123456789 | score |
|---|---|---|
| 2 | KLTQEQKTK | 27 |

TABLE XXV

V25-HLA-A3-9mers-98P4B6
Each peptide is a portion of SEQ ID NO: 51; each start position is specified, the length of peptide is 9 amino acids, and the end position for each peptide is the start position plus eight.

| Pos | 123456789 | score |
|---|---|---|
| 2 | LFLPCISQK | 21 |
| 1 | ILFLPCISQ | 15 |

TABLE XXV-continued

V25-HLA-A3-
9mers-98P4B6
Each peptide is a portion of
SEQ ID NO: 51; each start
position is specified, the
length of peptide is 9 amino
acids, and the end position
for each peptide is the start
position plus eight.

| Pos | 123456789 | score |
|---|---|---|
| 8 | SQKLKRIKK | 15 |
| 7 | ISQKLKRIK | 12 |
| 4 | LPCISQKLK | 11 |
| 3 | FLPCISQKL | 10 |
| 5 | PCISQKLKR | 10 |

TABLE XXVI

V1-HLA-A26-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|---|---|---|
| 352 | EEVWRIEMY | 29 |
| 75 | DVTHHEDAL | 28 |
| 441 | IVILDLLQL | 28 |
| 177 | QVIELARQL | 26 |
| 223 | ATFFFLYSF | 25 |
| 231 | FVRDVIHPY | 25 |
| 400 | YVALLISTF | 25 |
| 200 | EIENLPLRL | 24 |
| 261 | IVAITLLSL | 24 |
| 217 | VVAISLATF | 23 |
| 436 | LVLPSIVIL | 23 |
| 96 | EHYTSLWDL | 22 |
| 234 | DVIHPYARN | 22 |
| 353 | EVWRIEMYI | 22 |
| 390 | EFSFIQSTL | 22 |
| 396 | STLGYVALL | 21 |
| 90 | FVAIHREHY | 20 |
| 148 | VVSAWALQL | 20 |
| 253 | EIVNKTLPI | 20 |
| 264 | ITLLSLVYL | 20 |

TABLE XXVI-continued

V1-HLA-A26-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|---|---|---|
| 15 | ETCLPNGIN | 19 |
| 68 | EFFPHVVDV | 19 |
| 115 | DVSNNMRIN | 19 |
| 215 | PVVVAISLA | 19 |
| 296 | ETWLQCRKQ | 19 |
| 31 | VTVGVIGSG | 18 |
| 187 | FIPIDLGSL | 18 |
| 216 | VVVAISLAT | 18 |
| 406 | STFHVLIYG | 18 |
| 439 | PSIVILDLL | 18 |
| 2 | ESISMMGSP | 17 |
| 45 | LTIRLIRCG | 17 |
| 46 | TIRLIRCGY | 17 |
| 108 | LVGKILIDV | 17 |
| 263 | AITLLSLVY | 17 |
| 360 | YISFGIMSL | 17 |
| 363 | FGIMSLGLL | 17 |
| 30 | KVTVGVIGS | 16 |
| 117 | SNNMRINQY | 16 |
| 128 | SNAEYLASL | 16 |
| 259 | LPIVAITLL | 16 |
| 355 | WRIEMYISF | 16 |
| 392 | SFIQSTLGY | 16 |
| 405 | ISTFHVLIY | 16 |
| 432 | FVLALVLPS | 16 |
| 32 | TVGVIGSGD | 15 |
| 34 | GVIGSGDFA | 15 |
| 72 | HVVDVTHHE | 15 |
| 147 | NVVSAWALQ | 15 |
| 257 | KTLPIVAIT | 15 |
| 268 | SLVYLAGLL | 15 |
| 329 | ERYLFLNMA | 15 |
| 340 | QVHANIENS | 15 |

TABLE XXVI-continued

V1-HLA-A26-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|---|---|---|
| 375 | AVTSIPSVS | 15 |
| 378 | SIPSVSNAL | 15 |
| 381 | SVSNALNWR | 15 |
| 428 | TPPNFVLAL | 15 |
| 55 | HVVIGSRNP | 14 |
| 56 | VVIGSRNPK | 14 |
| 57 | VIGSRNPKF | 14 |
| 83 | LTKTNIIFV | 14 |
| 131 | EYLASLFPD | 14 |
| 138 | PDSLIVKGF | 14 |
| 180 | ELARQLNFI | 14 |
| 214 | GPVVVAISL | 14 |
| 218 | VAISLATFF | 14 |
| 254 | IVNKTLPIV | 14 |
| 302 | RKQLGLLSF | 14 |
| 303 | KQLGLLSFF | 14 |
| 316 | HVAYSLCLP | 14 |
| 365 | IMSLGLLSL | 14 |
| 366 | MSLGLLSLL | 14 |
| 430 | PNFVLALVL | 14 |
| 444 | LDLLQLCRY | 14 |

TABLE XXVI

V2-HLA-A26-
9mers-98P4B6
Each peptide is a portion of
SEQ ID NO: 5; each start
position is specified, the
length of peptide is 9 amino
acids, and the end position
for each peptide is the start
position plus eight.

| Pos | 123456789 | score |
|---|---|---|
| 17 | FTPFSCLSL | 18 |
| 1 | SGSPGLQAL | 15 |
| 15 | SGFTPFSCL | 14 |
| 3 | SPGLQALSL | 11 |

TABLE XXVI-continued

V2-HLA-A26-
9mers-98P4B6
Each peptide is a portion of
SEQ ID NO: 5; each start
position is specified, the
length of peptide is 9 amino
acids, and the end position
for each peptide is the start
position plus eight.

| Pos | 123456789 | score |
|---|---|---|
| 5 | GLQALSLSL | 11 |
| 9 | LSLSLSSGF | 11 |
| 18 | TPFSCLSLP | 11 |
| 23 | LSLPSSWDY | 11 |
| 12 | SLSSGFTPF | 10 |
| 36 | PCPADFFLY | 10 |
| 37 | CPADFFLYF | 10 |
| 33 | CPPPCPADF | 9 |
| 35 | PPCPADFFL | 9 |
| 30 | DYRCPPPCP | 8 |
| 34 | PPPCPADFF | 8 |

TABLE XXVI

V5A-HLA-A26-
9mers-98P4B6
Each peptide is a portion of
SEQ ID NO: 11; each start
position is specified, the
length of peptide is 9 amino
acids, and the end position
for each peptide is the start
position plus eight.

| Pos | 123456789 | score |
|---|---|---|
| 1 | NLPLRLFTF | 13 |
| 7 | FTFWRGPVV | 13 |

TABLE XXVI

V5B-HLA-A26-
9mers-98P4B6
Each peptide is a portion of
SEQ ID NO: 11; each start
position is specified, the
length of peptide is 9 amino
acids, and the end position
for each peptide is the start
position plus eight.

| Pos | 123456789 | score |
|---|---|---|
| 23 | EFVFLLTLL | 27 |
| 24 | FVFLLTLLL | 24 |
| 15 | DTQTELELE | 20 |
| 19 | ELELEFVFL | 18 |

TABLE XXVI-continued

V5B-HLA-A26-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 22 | LEFVFLLTL | 18 |
| 2 | REFSFIQIF | 17 |
| 5 | SFIQIFCSF | 16 |
| 16 | TQTELELEF | 14 |
| 20 | LELEFVFLL | 14 |
| 3 | EFSFIQIFC | 13 |

TABLE XXVI

V6-HLA-A26-9mers-98P4B6
Each peptide is a portion of SEQ ID NO: 13; each start position is specified, the length of peptide is 9 amino acids, and the end position for each peptide is the start position plus eight.

| Pos | 123456789 | score |
|---|---|---|
| 5 | IVILGKIIL | 23 |
| 6 | VILGKIILF | 18 |
| 41 | GTIPHVSPE | 18 |
| 7 | ILGKIILFL | 15 |
| 37 | EGIGGTIPH | 15 |
| 30 | EKSQFLEEG | 14 |
| 3 | PSIVILGKI | 12 |
| 10 | KIILFLPCI | 12 |
| 45 | HVSPERVTV | 12 |
| 4 | SIVILGKII | 11 |
| 14 | FLPCISRKL | 11 |
| 27 | KGWEKSQFL | 11 |
| 36 | EEGIGGTIP | 11 |

TABLE XXVI

V7A-HLA-A26-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 7 | ETFLPNGIN | 23 |
| 1 | SPKSLSETF | 12 |

TABLE XXVI

V7B-HLA-A26-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 9 | STLGYVALL | 21 |
| 5 | AYQQSTLGY | 11 |
| 3 | NMAYQQSTL | 10 |
| 8 | QSTLGYVAL | 10 |

TABLE XXVI

V7C-HLA-A26-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 169 | ETIILSKLT | 23 |
| 34 | EIVLPIEWQ | 22 |
| 11 | EVLASPAAA | 21 |
| 151 | FTSWSLGEF | 21 |
| 179 | EQKSKHCMF | 21 |
| 126 | GVGPLWEFL | 20 |
| 3 | IVILDLSVE | 19 |
| 85 | PVVGVVTED | 18 |
| 168 | LETIILSKL | 17 |
| 125 | NGVGPLWEF | 16 |
| 132 | EFLLRLLKS | 16 |

TABLE XXVI-continued

V7C-HLA-A26-
9mers-98P4B6
Each peptide is a portion of
SEQ ID NO: 15; each start
position is specified, the
length of peptide is 9 amino
acids, and the end position
for each peptide is the start
position plus eight.

| Pos | 123456789 | score |
|---|---|---|
| 95 | EAQDSIDPP | 15 |
| 129 | PLWEFLLRL | 15 |
| 7 | DLSVEVLAS | 14 |
| 35 | IVLPIEWQQ | 14 |
| 68 | EAQESGIRN | 14 |
| 88 | GVVTEDDEA | 14 |
| 89 | VVTEDDEAQ | 14 |
| 98 | DSIDPPESP | 14 |
| 122 | PHTNGVGPL | 14 |
| 163 | GTWMKLETI | 14 |
| 9 | SVEVLASPA | 13 |
| 42 | QQDRKIPPL | 13 |
| 92 | EDDEAQDSI | 13 |
| 104 | ESPDRALKA | 13 |
| 130 | LWEFLLRLL | 13 |
| 2 | SIVILDLSV | 12 |
| 5 | ILDLSVEVL | 12 |
| 59 | WTEEAGATA | 12 |
| 152 | TSWSLGEFL | 12 |
| 176 | LTQEQKSKH | 12 |
| 8 | LSVEVLASP | 11 |
| 45 | RKIPPLSTP | 11 |
| 51 | STPPPPAMW | 11 |
| 62 | EAGATAEAQ | 11 |
| 65 | ATAEAQESG | 11 |
| 71 | ESGIRNKSS | 11 |
| 82 | SQIPVVGVV | 11 |
| 119 | PVLPHTNGV | 11 |
| 141 | QAASGTLSL | 11 |
| 143 | ASGTLSLAF | 11 |
| 145 | GTLSLAFTS | 11 |
| 158 | EFLGSGTWM | 11 |
| 170 | TIILSKLTQ | 11 |

TABLE XXVI-continued

V7C-HLA-A26-
9mers-98P4B6
Each peptide is a portion of
SEQ ID NO: 15; each start
position is specified, the
length of peptide is 9 amino
acids, and the end position
for each peptide is the start
position plus eight.

| Pos | 123456789 | score |
|---|---|---|
| 171 | IILSKLTQE | 11 |
| 185 | CMFSLISGS | 11 |

TABLE XXVI

V8-HLA-A26-
9mers-98P4B6
Each peptide is a portion of
SEQ ID NO: 17; each start
position is specified, the
length of peptide is 9 amino
acids, and the end position
for each peptide is the start
position plus eight.

| Pos | 123456789 | score |
|---|---|---|
| 6 | EEGMGGTIP | 11 |
| 7 | EGMGGTIPH | 11 |
| 2 | SQFLEEGMG | 7 |

TABLE XXVI

V13-HLA-A26-
9mers-98P4B6
Each peptide is a portion of
SEQ ID NO: 27; each start
position is specified, the
length of peptide is 9 amino
acids, and the end position
for each peptide is the start
position plus eight.

| Pos | 123456789 | score |
|---|---|---|
| 7 | ETFLPNGIN | 23 |
| 1 | SPKSLSETF | 12 |

TABLE XXVI

V14-HLA-A26-
9mers-98P4B6
Each peptide is a portion of
SEQ ID NO: 29; each start
position is specified, the
length of peptide is 9 amino
acids, and the end position
for each peptide is the start
position plus eight.

| Pos | 123456789 | score |
|---|---|---|
| 1 | NLPLRLFTF | 13 |
| 7 | FTFWRGPVV | 13 |

TABLE XXVI

V21-HLA-A26-
9mers-98P4B6
Each peptide is a portion of
SEQ ID NO: 43; each start
position is specified, the
length of peptide is 9 amino
acids, and the end position
for each peptide is the start
position plus eight.

| Pos | 123456789 | score |
|---|---|---|
| 6 | EQKTKHCMF | 20 |
| 8 | KTKHCMFSL | 17 |
| 3 | LTQEQKTKH | 11 |

TABLE XXVI

V25-HLA-A26-
9mers-98P4B6
Each peptide is a portion of
SEQ ID NO: 51; each start
position is specified, the
length of peptide is 9 amino
acids, and the end position
for each peptide is the start
position plus eight.

| Pos | 123456789 | score |
|---|---|---|
| 3 | FLPCISQKL | 11 |
| 6 | CISQKLKRI | 9 |
| 2 | LFLPCISQK | 7 |
| 5 | PCISQKLKR | 7 |
| 1 | ILFLPCISQ | 6 |
| 9 | QKLKRIKKG | 5 |

TABLE XXVII

V1-HLA-B0702-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|---|---|---|
| 428 | TPPNFVLAL | 24 |
| 438 | LPSIVILDL | 24 |
| 259 | LPIVAITLL | 21 |
| 291 | FPPWLETWL | 21 |
| 125 | YPESNAEYL | 20 |
| 214 | GPVVVAISL | 20 |
| 250 | IPIEIVNKT | 18 |
| 62 | NPKFASEFF | 17 |

TABLE XXVII-continued

V1-HLA-B0702-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|---|---|---|
| 211 | LWRGPVVVA | 17 |
| 429 | PPNFVLALV | 17 |
| 157 | GPKDASRQV | 16 |
| 326 | RRSERYLFL | 16 |
| 148 | VVSAWALQL | 15 |
| 198 | AREIENLPL | 15 |
| 365 | IMSLGLLSL | 15 |
| 426 | FYTPPNFVL | 15 |
| 93 | IHREHYTSL | 14 |
| 220 | ISLATFFFL | 14 |
| 261 | IVAITLLSL | 14 |
| 287 | KYRRFPPWL | 14 |
| 379 | IPSVSNALN | 14 |
| 396 | STLGYVALL | 14 |
| 5 | SMMGSPKSL | 13 |
| 10 | PKSLSETCL | 13 |
| 137 | FPDSLIVKG | 13 |
| 173 | QARQQVIEL | 13 |
| 200 | EIENLPLRL | 13 |
| 264 | ITLLSLVYL | 13 |
| 289 | RRFPPWLET | 13 |
| 300 | QCRKQLGLL | 13 |
| 315 | VHVAYSLCL | 13 |
| 362 | SFGIMSLGL | 13 |
| 390 | EFSFIQSTL | 13 |
| 395 | QSTLGYVAL | 13 |
| 430 | PNFVLALVL | 13 |
| 436 | LVLPSIVIL | 13 |
| 441 | IVILDLLQL | 13 |
| 18 | LPNGINGIK | 12 |
| 27 | DARKVTVGV | 12 |
| 50 | IRCGYHVVI | 12 |
| 70 | FPHVVDVTH | 12 |
| 105 | RHLLVGKIL | 12 |

TABLE XXVII-continued

V1-HLA-B0702-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|-----|-----------|-------|
| 128 | SNAEYLASL | 12 |
| 133 | LASLFPDSL | 12 |
| 188 | IPIDLGSLS | 12 |
| 202 | ENLPLRLFT | 12 |
| 204 | LPLRLFTLW | 12 |
| 212 | WRGPVVVAI | 12 |
| 219 | AISLATFFF | 12 |
| 256 | NKTLPIVAI | 12 |
| 299 | LQCRKQLGL | 12 |
| 313 | AMVHVAYSL | 12 |
| 324 | PMRRSERYL | 12 |
| 360 | YISFGIMSL | 12 |
| 366 | MSLGLLSLL | 12 |
| 403 | LLISTFHVL | 12 |
| 435 | ALVLPSIVI | 12 |
| 25  | IKDARKVTV | 11 |
| 37  | GSGDFAKSL | 11 |
| 41  | FAKSLTIRL | 11 |
| 68  | EFFPHVVDV | 11 |
| 75  | DVTHHEDAL | 11 |
| 85  | KTNIIFVAI | 11 |
| 96  | EHYTSLWDL | 11 |
| 100 | SLWDLRHLL | 11 |
| 134 | ASLFPDSLI | 11 |
| 146 | FNVVSAWAL | 11 |
| 196 | SSAREIENL | 11 |
| 237 | HPYARNQQS | 11 |
| 253 | EIVNKTLPI | 11 |
| 267 | LSLVYLAGL | 11 |
| 271 | YLAGLLAAA | 11 |
| 274 | GLLAAAYQL | 11 |
| 292 | PPWLETWLQ | 11 |
| 297 | TWLQCRKQL | 11 |

TABLE XXVII-continued

V1-HLA-B0702-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|-----|-----------|-------|
| 323 | LPMRRSERY | 11 |
| 328 | SERYLFLNM | 11 |
| 378 | SIPSVSNAL | 11 |
| 394 | IQSTLGYVA | 11 |
| 425 | RFYTPPNFV | 11 |

TABLE XXVII

V2-HLA-B0702-
9mers-98P4B6
Each peptide is a portion of
SEQ ID NO: 5; each start
position is specified, the
length of peptide is 9 amino
acids, and the end position
for each peptide is the start
position plus eight.

| Pos | 123456789 | score |
|-----|-----------|-------|
| 3   | SPGLQALSL | 23 |
| 35  | PPCPADFFL | 22 |
| 34  | PPPCPADFF | 20 |
| 37  | CPADFFLYF | 20 |
| 33  | CPPPCPADF | 18 |
| 1   | SGSPGLQAL | 14 |
| 15  | SGFTPFSCL | 14 |
| 5   | GLQALSLSL | 13 |
| 17  | FTPFSCLSL | 12 |
| 25  | LPSSWDYRC | 12 |
| 12  | SLSSGFTPF | 11 |
| 31  | YRCPPPCPA | 11 |

TABLE XXVII

V5A-HLA-B0702-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 9 | FWRGPVVVA | 17 |
| 2 | LPLRLFTFW | 13 |
| 7 | FTFWRGPVV | 9 |
| 8 | TFWRGPVVV | 9 |
| 6 | LFTFWRGPV | 8 |

TABLE XXVII

V5B-HLA-B0702-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 19 | ELELEFVFL | 15 |
| 14 | ADTQTELEL | 14 |
| 24 | FVFLLTLLL | 13 |
| 12 | SFADTQTEL | 12 |
| 22 | LEFVFLLTL | 12 |
| 23 | EFVFLLTLL | 12 |
| 20 | LELEFVFLL | 11 |
| 21 | ELEFVFLLT | 10 |
| 10 | FCSFADTQT | 9 |
| 8 | QIFCSFADT | 8 |
| 16 | TQTELELEF | 8 |
| 1 | WREFSFIQI | 7 |
| 2 | REFSFIQIF | 7 |
| 5 | SFIQIFCSF | 7 |
| 6 | FIQIFCSFA | 7 |
| 17 | QTELELEFV | 7 |
| 18 | TELELEFVF | 7 |

TABLE XXVII

V6-HLA-B0702-9mers-98P4B6
Each peptide is a portion of SEQ ID NO: 13; each start position is specified, the length of peptide is 9 amino acids, and the end position for each peptide is the start position plus eight.

| Pos | 123456789 | score |
|---|---|---|
| 43 | IPHVSPERV | 17 |
| 7 | ILGKIILFL | 16 |
| 2 | LPSIVILGK | 14 |
| 27 | KGWEKSQFL | 12 |
| 45 | HVSPERVTV | 12 |
| 5 | IVILGKIIL | 11 |
| 15 | LPCISRKLK | 11 |
| 14 | FLPCISRKL | 10 |
| 38 | GIGGTIPHV | 10 |
| 44 | PHVSPERVT | 10 |
| 35 | LEEGIGGTI | 9 |
| 46 | VSPERVTVM | 9 |
| 6 | VILGKIILF | 8 |
| 10 | KIILFLPCI | 8 |
| 17 | CISRKLKRI | 8 |
| 26 | KKGWEKSQF | 8 |

TABLE XXVII

V7A-HLA-B0702-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 1 | SPKSLSETF | 16 |
| 2 | PKSLSETFL | 14 |

TABLE XXVII

V7B-HLA-B0702-
9mers-98P4B6
Each peptide is a portion of
SEQ ID NO: 15; each start
position is specified, the
length of peptide is 9 amino
acids, and the end position
for each peptide is the start
position plus eight.

| Pos | 123456789 | score |
|---|---|---|
| 9 | STLGYVALL | 14 |
| 8 | QSTLGYVAL | 13 |
| 3 | NMAYQQSTL | 11 |
| 7 | QQSTLGYVA | 10 |
| 2 | LNMAYQQST | 8 |
| 6 | YQQSTLGYV | 6 |

TABLE XXVII

V7C-HLA-B0702-
9mers-98P4B6
Each peptide is a portion of
SEQ ID NO: 15; each start
position is specified, the
length of peptide is 9 amino
acids, and the end position
for each peptide is the start
position plus eight.

| Pos | 123456789 | score |
|---|---|---|
| 102 | PPESPDRAL | 24 |
| 15 | SPAAAWKCL | 22 |
| 52 | TPPPPAMWT | 20 |
| 55 | PPAMWTEEA | 18 |
| 105 | SPDRALKAA | 18 |
| 101 | DPPESPDRA | 16 |
| 113 | ANSWRNPVL | 16 |
| 5 | ILDLSVEVL | 14 |
| 47 | IPPLSTPPP | 14 |
| 84 | IPVVGVVTE | 14 |
| 118 | NPVLPHTNG | 14 |
| 141 | QAASGTLSL | 14 |
| 160 | LGSGTWMKL | 14 |
| 29 | RGGLSEIVL | 13 |
| 42 | QQDRKIPPL | 13 |
| 49 | PLSTPPPPA | 13 |
| 121 | LPHTNGVGP | 13 |
| 126 | GVGPLWEFL | 13 |
| 128 | GPLWEFLLR | 13 |

TABLE XXVII-continued

V7C-HLA-B0702-
9mers-98P4B6
Each peptide is a portion of
SEQ ID NO: 15; each start
position is specified, the
length of peptide is 9 amino
acids, and the end position
for each peptide is the start
position plus eight.

| Pos | 123456789 | score |
|---|---|---|
| 31 | GLSEIVLPI | 12 |
| 48 | PPLSTPPPP | 12 |
| 50 | LSTPPPPAM | 12 |
| 54 | PPPAMWTEE | 12 |
| 61 | EEAGATAEA | 12 |
| 81 | SSQIPVVGV | 12 |
| 122 | PHTNGVGPL | 12 |
| 129 | PLWEFLLRL | 12 |
| 139 | KSQAASGTL | 12 |
| 142 | AASGTLSLA | 12 |
| 143 | ASGTLSLAF | 12 |
| 152 | TSWSLGEFL | 12 |
| 17 | AAAWKCLGA | 11 |
| 24 | GANILRGGL | 11 |
| 27 | ILRGGLSEI | 11 |
| 44 | DRKIPPLST | 11 |
| 53 | PPPPAMWTE | 11 |
| 125 | NGVGPLWEF | 11 |
| 148 | SLAFTSWSL | 11 |
| 158 | EFLGSGTWM | 11 |
| 165 | WMKLETIIL | 11 |
| 181 | KSKHCMFSL | 11 |

TABLE XXVII

V8-HLA-B0702-
9mers-98P4B6
Each peptide is a portion of
SEQ ID NO: 17; each start
position is specified, the
length of peptide is 9 amino
acids, and the end position
for each peptide is the start
position plus eight.

| Pos | 123456789 | score |
|---|---|---|
| 8 | GMGGTIPHV | 10 |
| 5 | LEEGMGGTI | 9 |
| 1 | KSQFLEEGM | 7 |

TABLE XXVII-continued

V8-HLA-B0702-
9mers-98P4B6
Each peptide is a portion of
SEQ ID NO: 17; each start
position is specified, the
length of peptide is 9 amino
acids, and the end position
for each peptide is the start
position plus eight.

| Pos | 123456789 | score |
|---|---|---|
| 4 | FLEEGMGGT | 6 |
| 7 | EGMGGTIPH | 6 |
| 6 | EEGMGGTIP | 4 |

TABLE XXVII

V13-HLA-B0702-
9mers-98P4B6
Each peptide is a portion of
SEQ ID NO: 27; each start
position is specified, the
length of peptide is 9 amino
acids, and the end position
for each peptide is the start
position plus eight.

| Pos | 123456789 | score |
|---|---|---|
| 1 | SPKSLSETF | 16 |
| 2 | PKSLSETFL | 14 |

TABLE XXVII

V14-HLA-B0702-
9mers-98P4B6
Each peptide is a portion of
SEQ ID NO: 29; each start
position is specified, the
length of peptide is 9 amino
acids, and the end position
for each peptide is the start
position plus eight.

| Pos | 123456789 | score |
|---|---|---|
| 9 | FWRGPVVVA | 17 |
| 2 | LPLRLFTFW | 13 |
| 7 | FTFWRGPVV | 9 |
| 8 | TFWRGPVVV | 9 |
| 6 | LFTFWRGPV | 8 |

TABLE XXVII

V21-HLA-B0702-
9mers-98P4B6
Each peptide is a portion of
SEQ ID NO: 43; each start
position is specified, the
length of peptide is 9 amino
acids, and the end position
for each peptide is the start
position plus eight.

| Pos | 123456789 | score |
|---|---|---|
| 8 | KTKHCMFSL | 11 |
| 5 | QEQKTKHCM | 7 |
| 6 | EQKTKHCMF | 7 |
| 9 | TKHCMFSLI | 7 |
| 1 | SKLTQEQKT | 6 |

TABLE XXVII

V25-HLA-B0702-
9mers-98P4B6
Each peptide is a portion of
SEQ ID NO: 51; each start
position is specified, the
length of peptide is 9 amino
acids, and the end position
for each peptide is the start
position plus eight.

| Pos | 123456789 | score |
|---|---|---|
| 3 | FLPCISQKL | 10 |
| 4 | LPCISQKLK | 10 |
| 6 | CISQKLKRI | 8 |
| 1 | ILFLPCISQ | 4 |

TABLE XXVIII

V1-HLA-B08-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|---|---|---|
| 41 | FAKSLTIRL | 25 |
| 203 | NLPLRLFTL | 25 |
| 62 | NPKFASEFF | 22 |
| 173 | QARQQVIEL | 22 |
| 253 | EIVNKTLPI | 22 |
| 57 | VIGSRNPKF | 20 |
| 81 | DALTKTNII | 20 |
| 285 | GTKYRRFPP | 20 |

TABLE XXVIII-continued

V1-HLA-B08-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|---|---|---|
| 299 | LQCRKQLGL | 20 |
| 326 | RRSERYLFL | 20 |
| 385 | ALNWREFSF | 20 |
| 93 | IHREHYTSL | 19 |
| 140 | SLIVKGFNV | 19 |
| 268 | SLVYLAGLL | 19 |
| 9 | SPKSLSETC | 18 |
| 28 | ARKVTVGVI | 18 |
| 100 | SLWDLRHLL | 18 |
| 171 | NIQARQQVI | 18 |
| 214 | GPVVVAISL | 18 |
| 259 | LPIVAITLL | 18 |
| 428 | TPPNFVLAL | 18 |
| 39 | GDFAKSLTI | 17 |
| 107 | LLVGKILID | 17 |
| 157 | GPKDASRQV | 17 |
| 274 | GLLAAAYQL | 17 |
| 291 | FPPWLETWL | 17 |
| 378 | SIPSVSNAL | 17 |
| 438 | LPSIVILDL | 17 |
| 24 | GIKDARKVT | 16 |
| 44 | SLTIRLIRC | 16 |
| 125 | YPESNAEYL | 16 |
| 155 | QLGPKDASR | 16 |
| 184 | QLNFIPIDL | 16 |
| 200 | EIENLPLRL | 16 |
| 237 | HPYARNQQS | 16 |
| 239 | YARNQQSDF | 16 |
| 251 | PIEIVNKTL | 16 |
| 258 | TLPIVAITL | 16 |
| 283 | YYGTKYRRF | 16 |
| 287 | KYRRFPPWL | 16 |
| 300 | QCRKQLGLL | 16 |
| 324 | PMRRSERYL | 16 |

TABLE XXVIII-continued

V1-HLA-B08-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|---|---|---|
| 403 | LLISTFHVL | 16 |
| 133 | LASLFPDSL | 15 |
| 159 | KDASRQVYI | 15 |
| 179 | IELARQLNF | 15 |
| 187 | FIPIDLGSL | 15 |
| 322 | CLPMRRSER | 15 |
| 360 | YISFGIMSL | 15 |
| 106 | HLLVGKILI | 14 |
| 128 | SNAEYLASL | 14 |
| 180 | ELARQLNFI | 14 |
| 197 | SAREIENLP | 14 |
| 245 | SDFYKIPIE | 14 |
| 298 | WLQCRKQLG | 14 |
| 323 | LPMRRSERY | 14 |
| 433 | VLALVLPSI | 14 |
| 5 | SMMGSPKSL | 13 |
| 17 | CLPNGINGI | 13 |
| 82 | ALTKTNIIF | 13 |
| 91 | VAIHREHYT | 13 |
| 103 | DLRHLLVGK | 13 |
| 142 | IVKGFNVVS | 13 |
| 146 | FNVVSAWAL | 13 |
| 196 | SSAREIENL | 13 |
| 205 | PLRLFTLWR | 13 |
| 264 | ITLLSLVYL | 13 |
| 304 | QLGLLSFFF | 13 |
| 395 | QSTLGYVAL | 13 |
| 396 | STLGYVALL | 13 |
| 397 | TLGYVALLI | 13 |
| 435 | ALVLPSIVI | 13 |
| 37 | GSGDFAKSL | 12 |
| 60 | SRNPKFASE | 12 |
| 96 | EHYTSLWDL | 12 |

TABLE XXVIII-continued

V1-HLA-B08-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 105 | RHLLVGKIL | 12 |
| 109 | VGKILIDVS | 12 |
| 177 | QVIELARQL | 12 |
| 247 | FYKIPIEIY | 12 |
| 325 | MRRSERYLF | 12 |
| 362 | SFGIMSLGL | 12 |
| 365 | IMSLGLLSL | 12 |
| 390 | EFSFIQSTL | 12 |
| 414 | GWKRAFEEE | 12 |
| 426 | FYTPPNFVL | 12 |
| 436 | LVLPSIVIL | 12 |
| 441 | IVILDLLQL | 12 |

TABLE XXVIII

V2-HLA-B08-9mers-98P4B6
Each peptide is a portion of SEQ ID NO: 5; each start position is specified, the length of peptide is 9 amino acids, and the end position for each peptide is the start position plus eight.

| Pos | 123456789 | score |
|---|---|---|
| 3 | SPGLQALSL | 19 |
| 5 | GLQALSLSL | 17 |
| 35 | PPCPADFFL | 16 |
| 12 | SLSSGFTPF | 14 |
| 1 | SGSPGLQAL | 13 |
| 15 | SGFTPFSCL | 12 |
| 33 | CPPPCPADF | 12 |
| 34 | PPPCPADFF | 12 |
| 37 | CPADFFLYF | 12 |
| 17 | FTPFSCLSL | 11 |
| 28 | SWDYRCPPP | 11 |
| 10 | SLSLSSGFT | 9 |

TABLE XXIX

V5A-HLA-B08-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 1 | NLPLRLFTF | 21 |
| 3 | PLRLFTFWR | 13 |

TABLE XXIX

V5B-HLA-B08-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 19 | ELELEFVFL | 20 |
| 12 | SFADTQTEL | 13 |
| 20 | LELEFVFLL | 13 |
| 23 | EFVFLLTLL | 12 |
| 24 | FVFLLTLLL | 12 |
| 14 | ADTQTELEL | 11 |
| 22 | LEFVFLLTL | 11 |
| 16 | TQTELELEF | 9 |

TABLE XXIX

V6-HLA-B08-9mers-98P4B6
Each peptide is a portion of SEQ ID NO: 13; each start position is specified, the length of peptide is 9 amino acids, and the end position for each peptide is the start position plus eight.

| Pos | 123456789 | score |
|---|---|---|
| 19 | SRKLKRIKK | 23 |
| 6 | VILGKIILF | 22 |
| 27 | KGWEKSQFL | 22 |
| 17 | CISRKLKRI | 21 |
| 7 | ILGKIILFL | 18 |
| 14 | FLPCISRKL | 17 |
| 21 | KLKRIKKGW | 17 |

TABLE XXIX-continued

V6-HLA-B08-
9mers-98P4B6
Each peptide is a portion of
SEQ ID NO: 13; each start
position is specified, the
length of peptide is 9 amino
acids, and the end position
for each peptide is the start
position plus eight.

| Pos | 123456789 | score |
|---|---|---|
| 22 | LKRIKKGWE | 16 |
| 24 | RIKKGWEKS | 14 |
| 4 | SIVILGKII | 13 |
| 5 | IVILGKIIL | 12 |
| 25 | IKKGWEKSQ | 12 |
| 46 | VSPERVTVM | 12 |
| 10 | KIILFLPCI | 11 |
| 23 | KRIKKGWEK | 11 |
| 29 | WEKSQFLEE | 11 |

TABLE XXIX

V7A-HLA-B08-
9mers-98P4B6
Each peptide is a portion of
SEQ ID NO: 15; each start
position is specified, the
length of peptide is 9 amino
acids, and the end position
for each peptide is the start
position plus eight.

| Pos | 123456789 | score |
|---|---|---|
| 1 | SPKSLSETF | 24 |
| 9 | FLPNGINGI | 14 |
| 2 | PKSLSETFL | 11 |

TABLE XXIX

V7B-HLA-B08-
9mers-98P4B6
Each peptide is a portion of
SEQ ID NO: 15; each start
position is specified, the
length of peptide is 9 amino
acids, and the end position
for each peptide is the start
position plus eight.

| Pos | 123456789 | score |
|---|---|---|
| 8 | QSTLGYVAL | 13 |
| 9 | STLGYVALL | 13 |
| 3 | NMAYQQSTL | 11 |
| 1 | FLNMAYQQS | 7 |

TABLE XXIX

V7C-HLA-B08-
9mers-98P4B6
Each peptide is a portion of
SEQ ID NO: 15; each start
position is specified, the
length of peptide is 9 amino
acids, and the end position
for each peptide is the start
position plus eight.

| Pos | 123456789 | score |
|---|---|---|
| 179 | EQKSKHCMF | 28 |
| 42 | QQDRKIPPL | 21 |
| 73 | GIRNKSSSS | 21 |
| 165 | WMKLETIIL | 21 |
| 27 | ILRGGLSEI | 20 |
| 181 | KSKHCMFSL | 20 |
| 5 | ILDLSVEVL | 19 |
| 15 | SPAAAWKCL | 19 |
| 113 | ANSWRNPVL | 19 |
| 129 | PLWEFLLRL | 18 |
| 148 | SLAFTSWSL | 18 |
| 102 | PPESPDRAL | 17 |
| 109 | ALKAANSWR | 17 |
| 163 | GTWMKLETI | 17 |
| 19 | AWKCLGANI | 16 |
| 31 | GLSEIVLPI | 16 |
| 137 | LLKSQAASG | 16 |
| 24 | GANILRGGL | 15 |
| 171 | IILSKLTQE | 15 |
| 17 | AAAWKCLGA | 14 |
| 141 | QAASGTLSL | 14 |
| 134 | LLRLLKSQA | 13 |

TABLE XXIX

V8-HLA-B08-
9mers-98P4B6
Each peptide is a portion of
SEQ ID NO: 17; each start
position is specified, the
length of peptide is 9 amino
acids, and the end position
for each peptide is the start
position plus eight.

| Pos | 123456789 | score |
|---|---|---|
| 4 | FLEEGMGGT | 9 |
| 5 | LEEGMGGTI | 6 |

TABLE XXIX

V13-HLA-B08-9mers-98P4B6

Each peptide is a portion of SEQ ID NO: 27; each start position is specified, the length of peptide is 9 amino acids, and the end position for each peptide is the start position plus eight.

| Pos | 123456789 | score |
|---|---|---|
| 1 | SPKSLSETF | 24 |
| 9 | FLPNGINGI | 14 |
| 2 | PKSLSETFL | 11 |

TABLE XXIX

V14-HLA-B08-9mers-98P4B6

Each peptide is a portion of SEQ ID NO: 29; each start position is specified, the length of peptide is 9 amino acids, and the end position for each peptide is the start position plus eight.

| Pos | 123456789 | score |
|---|---|---|
| 1 | NLPLRLFTF | 21 |
| 3 | PLRLFTFWR | 13 |

TABLE XXIX

V21-HLA-B08-9mers-98P4B6

Each peptide is a portion of SEQ ID NO: 43; each start position is specified, the length of peptide is 9 amino acids, and the end position for each peptide is the start position plus eight.

| Pos | 123456789 | score |
|---|---|---|
| 6 | EQKTKHCMF | 28 |
| 8 | KTKHCMFSL | 20 |
| 4 | TQEQKTKHC | 11 |

TABLE XXIX

V25-HLA-B08-9mers-98P4B6

Each peptide is a portion of SEQ ID NO: 51; each start position is specified, the length of peptide is 9 amino acids, and the end position for each peptide is the start position plus eight.

| Pos | 123456789 | score |
|---|---|---|
| 8 | SQKLKRIKK | 23 |
| 6 | CISQKLKRI | 21 |
| 3 | FLPCISQKL | 17 |

TABLE XXIX

V1-HLA-B1510-9mers-98P4B6

Each peptide is a portion of SEQ ID NO: 3; each start position is specified, the length of peptide is 9 amino acids, and the end position for each peptide is the start position plus eight.

| Pos | 123456789 | score |
|---|---|---|
| 93 | IHREHYTSL | 23 |
| 96 | EHYTSLWDL | 21 |
| 105 | RHLLVGKIL | 20 |
| 315 | VHVAYSLCL | 20 |
| 200 | EIENLPLRL | 15 |
| 426 | FYTPPNFVL | 15 |
| 436 | LVLPSIVIL | 15 |
| 54 | YHVVIGSRN | 14 |
| 264 | ITLLSLVYL | 14 |
| 360 | YISFGIMSL | 14 |
| 365 | IMSLGLLSL | 14 |
| 395 | QSTLGYVAL | 14 |
| 77 | THHEDALTK | 13 |
| 99 | TSLWDLRHL | 13 |
| 125 | YPESNAEYL | 13 |
| 173 | QARQQVIEL | 13 |
| 177 | QVIELARQL | 13 |
| 236 | IHPYARNQQ | 13 |
| 261 | IVAITLLSL | 13 |
| 297 | TWLQCRKQL | 13 |
| 390 | EFSFIQSTL | 13 |
| 428 | TPPNFVLAL | 13 |

TABLE XXIX-continued

V1-HLA-B1510-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 430 | PNFVLALVL | 13 |
| 5 | SMMGSPKSL | 12 |
| 37 | GSGDFAKSL | 12 |
| 41 | FAKSLTIRL | 12 |
| 71 | PHVVDVTHH | 12 |
| 78 | HHEDALTKT | 12 |
| 100 | SLWDLRHLL | 12 |
| 128 | SNAEYLASL | 12 |
| 133 | LASLFPDSL | 12 |
| 146 | FNVVSAWAL | 12 |
| 196 | SSAREIENL | 12 |
| 214 | GPVVVAISL | 12 |
| 220 | ISLATFFFL | 12 |
| 251 | PIEIVNKTL | 12 |
| 258 | TLPIVAITL | 12 |
| 259 | LPIVAITLL | 12 |
| 287 | KYRRFPPWL | 12 |
| 324 | PMRRSERYL | 12 |
| 326 | RRSERYLFL | 12 |
| 396 | STLGYVALL | 12 |
| 403 | LLISTFHVL | 12 |
| 438 | LPSIVILDL | 12 |
| 441 | IVILDLLQL | 12 |
| 10 | PKSLSETCL | 11 |
| 75 | DVTHHEDAL | 11 |
| 148 | VVSAWALQL | 11 |
| 184 | QLNFIPIDL | 11 |
| 198 | AREIENLPL | 11 |
| 201 | IENLPLRLF | 11 |
| 203 | NLPLRLFTL | 11 |
| 267 | LSLVYLAGL | 11 |
| 274 | GLLAAAYQL | 11 |
| 283 | YYGTKYRRF | 11 |

TABLE XXIX-continued

V1-HLA-B1510-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 300 | QCRKQLGLL | 11 |
| 341 | VHANIENSW | 11 |
| 351 | EEEVWRIEM | 11 |
| 366 | MSLGLLSLL | 11 |
| 378 | SIPSVSNAL | 11 |
| 383 | SNALNWREF | 11 |
| 411 | LIYGWKRAF | 11 |
| 439 | PSIVILDLL | 11 |

TABLE XXIX

V2-HLA-B1510-9mers-98P4B6
Each peptide is a portion of SEQ ID NO: 5; each start position is specified, the length of peptide is 9 amino acids, and the end position for each peptide is the start position plus eight.

| Pos | 123456789 | score |
|---|---|---|
| 1 | SGSPGLQAL | 15 |
| 35 | PPCPADFFL | 12 |
| 5 | GLQALSLSL | 11 |
| 15 | SGFTPFSCL | 11 |
| 3 | SPGLQALSL | 10 |
| 17 | FTPFSCLSL | 10 |
| 33 | CPPPCPADF | 9 |
| 12 | SLSSGFTPF | 8 |
| 37 | CPADFFLYF | 8 |
| 34 | PPPCPADFF | 7 |

TABLE XXIX

V5A-HLA-B1510-9mers-98P4B6

Each peptide is a portion of SEQ ID NO: 11; each start position is specified, the length of peptide is 9 amino acids, and the end position for each peptide is the start position plus eight.

| Pos | 123456789 | score |
|---|---|---|
| 1 | NLPLRLFTF | 7 |
| 8 | TFWRGPVVV | 7 |
| 9 | FWRGPVVVA | 7 |
| 7 | FTFWRGPVV | 3 |

TABLE XXIX

V5B-HLA-B1510-9mers-98P4B6

Each peptide is a portion of SEQ ID NO: 11; each start position is specified, the length of peptide is 9 amino acids, and the end position for each peptide is the start position plus eight.

| Pos | 123456789 | score |
|---|---|---|
| 19 | ELELEFVFL | 14 |
| 12 | SFADTQTEL | 13 |
| 14 | ADTQTELEL | 12 |
| 20 | LELEFVFLL | 12 |
| 22 | LEFVFLLTL | 12 |
| 23 | EFVFLLTLL | 11 |
| 18 | TELELEFVF | 10 |
| 24 | FVFLLTLLL | 10 |
| 16 | TQTELELEF | 9 |
| 2 | REFSFIQIF | 7 |
| 5 | SFIQIFCSF | 7 |

TABLE XXIX

V6-HLA-B1510-9mers-98P4B6

Each peptide is a portion of SEQ ID NO: 13; each start position is specified, the length of peptide is 9 amino acids, and the end position for each peptide is the start position plus eight.

| Pos | 123456789 | score |
|---|---|---|
| 44 | PHVSPERVT | 15 |
| 5 | IVILGKIIL | 14 |

TABLE XXIX-continued

V6-HLA-B1510-9mers-98P4B6

Each peptide is a portion of SEQ ID NO: 13; each start position is specified, the length of peptide is 9 amino acids, and the end position for each peptide is the start position plus eight.

| Pos | 123456789 | score |
|---|---|---|
| 7 | ILGKIILFL | 14 |
| 14 | FLPCISRKL | 12 |
| 27 | KGWEKSQFL | 11 |
| 46 | VSPERVTVM | 10 |
| 6 | VILGKIILF | 8 |
| 26 | KKGWEKSQF | 7 |
| 45 | HVSPERVTV | 7 |

TABLE XXIX

V7A-HLA-B1510-9mers-98P4B6

Each peptide is a portion of SEQ ID NO: 15; each start position is specified, the length of peptide is 9 amino acids, and the end position for each peptide is the start position plus eight.

| Pos | 123456789 | score |
|---|---|---|
| 2 | PKSLSETFL | 11 |
| 1 | SPKSLSETF | 7 |

TABLE XXIX

V7B-HLA-B1510-9mers-98P4B6

Each peptide is a portion of SEQ ID NO: 15; each start position is specified, the length of peptide is 9 amino acids, and the end position for each peptide is the start position plus eight.

| Pos | 123456789 | score |
|---|---|---|
| 8 | QSTLGYVAL | 14 |
| 3 | NMAYQQSTL | 12 |
| 9 | STLGYVALL | 12 |

TABLE XXIX

V7C-HLA-B1510-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 122 | PHTNGVGPL | 22 |
| 5 | ILDLSVEVL | 15 |
| 102 | PPESPDRAL | 15 |
| 113 | ANSWRNPVL | 14 |
| 126 | GVGPLWEFL | 13 |
| 129 | PLWEFLLRL | 13 |
| 130 | LWEFLLRLL | 13 |
| 24 | GANILRGGL | 12 |
| 29 | RGGLSEIVL | 12 |
| 42 | QQDRKIPPL | 12 |
| 50 | LSTPPPPAM | 12 |
| 141 | QAASGTLSL | 12 |
| 160 | LGSGTWMKL | 12 |
| 15 | SPAAAWKCL | 11 |
| 20 | WKCLGANIL | 11 |
| 139 | KSQAASGTL | 11 |
| 148 | SLAFTSWSL | 11 |
| 152 | TSWSLGEFL | 11 |
| 181 | KSKHCMFSL | 11 |
| 127 | VGPLWEFLL | 10 |
| 165 | WMKLETIIL | 10 |
| 168 | LETIILSKL | 10 |
| 183 | KHCMFSLIS | 10 |

TABLE XXIX

V8-HLA-B1510-9mers-98P4B6
Each peptide is a portion of SEQ ID NO: 17; each start position is specified, the length of peptide is 9 amino acids, and the end position for each peptide is the start position plus eight.

| Pos | 123456789 | score |
|---|---|---|
| 1 | KSQFLEEGM | 6 |
| 4 | FLEEGMGGT | 4 |
| 8 | GMGGTIPHV | 4 |
| 5 | LEEGMGGTI | 3 |

TABLE XXIX-continued

V8-HLA-B1510-9mers-98P4B6
Each peptide is a portion of SEQ ID NO: 17; each start position is specified, the length of peptide is 9 amino acids, and the end position for each peptide is the start position plus eight.

| Pos | 123456789 | score |
|---|---|---|
| 7 | EGMGGTIPH | 3 |
| 9 | MGGTIPHVS | 3 |
| 6 | EEGMGGTIP | 2 |

TABLE XXIX

V13-HLA-B1510-9mers-98P4B6
Each peptide is a portion of SEQ ID NO: 27; each start position is specified, the length of peptide is 9 amino acids, and the end position for each peptide is the start position plus eight.

| Pos | 123456789 | score |
|---|---|---|
| 2 | PKSLSETFL | 11 |
| 1 | SPKSLSETF | 7 |

TABLE XXIX

V14-HLA-B1510-9mers-98P4B6
Each peptide is a portion of SEQ ID NO: 29; each start position is specified, the length of peptide is 9 amino acids, and the end position for each peptide is the start position plus eight.

| Pos | 123456789 | score |
|---|---|---|
| 1 | NLPLRLFTF | 7 |
| 8 | TFWRGPVVV | 7 |
| 9 | FWRGPVVVA | 7 |
| 7 | FTFWRGPVV | 3 |

TABLE XXIX

V21-HLA-B1510-9mers-98P4B6
Each peptide is a portion of SEQ ID NO: 43; each start position is specified, the length of peptide is 9 amino acids, and the end position for each peptide is the start position plus eight.

| Pos | 123456789 | score |
|---|---|---|
| 8 | KTKHCMFSL | 11 |
| 5 | QEQKTKHCM | 8 |
| 6 | EQKTKHCMF | 7 |
| 4 | TQEQKTKHC | |

TABLE XXIX

V25-HLA-B1510-9mers-98P4B6
Each peptide is a portion of SEQ ID NO: 51; each start position is specified, the length of peptide is 9 amino acids, and the end position for each peptide is the start position plus eight.

| Pos | 123456789 | score |
|---|---|---|
| 3 | FLPCISQKL | 10 |
| 7 | ISQKLKRIK | 6 |
| 6 | CISQKLKRI | 4 |

TABLE XXIX

V1-HLA-B2705-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 326 | RRSERYLFL | 26 |
| 424 | YRFYTPPNF | 26 |
| 355 | WRIEMYISF | 25 |
| 198 | AREIENLPL | 24 |
| 240 | ARNQQSDFY | 22 |
| 325 | MRRSERYLF | 22 |
| 47 | IRLIRCGYH | 21 |
| 50 | IRCGYHVVI | 21 |
| 104 | LRHLLVGKI | 21 |
| 289 | RRFPPWLET | 21 |
| 416 | KRAFEEEYY | 21 |
| 212 | WRGPVVVAI | 20 |
| 302 | RKQLGLLSF | 20 |
| 417 | RAFEEEYYR | 20 |
| 28 | ARKVTVGVI | 19 |
| 61 | RNPKFASEF | 19 |
| 182 | ARQLNFIPI | 19 |
| 199 | REIENLPLR | 19 |
| 249 | KIPIEIVNK | 19 |
| 303 | KQLGLLSFF | 19 |
| 53 | GYHVVIGSR | 18 |
| 105 | RHLLVGKIL | 18 |
| 179 | IELARQLNF | 18 |
| 214 | GPVVVAISL | 18 |
| 241 | RNQQSDFYK | 18 |
| 274 | GLLAAAYQL | 18 |

TABLE XXIX-continued

V1-HLA-B2705-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 282 | LYYGTKYRR | 18 |
| 436 | LVLPSIVIL | 18 |
| 21 | GINGIKDAR | 17 |
| 174 | ARQQVIELA | 17 |
| 223 | ATFFFLYSF | 17 |
| 259 | LPIVAITLL | 17 |
| 264 | ITLLSLVYL | 17 |
| 330 | RYLFLNMAY | 17 |
| 360 | YISFGIMSL | 17 |
| 365 | IMSLGLLSL | 17 |
| 366 | MSLGLLSLL | 17 |
| 400 | YVALLISTF | 17 |
| 430 | PNFVLALVL | 17 |
| 441 | IVILDLLQL | 17 |
| 22 | INGIKDARK | 16 |
| 39 | GDFAKSLTI | 16 |
| 40 | DFAKSLTIR | 16 |
| 43 | KSLTIRLIR | 16 |
| 56 | VVIGSRNPK | 16 |
| 112 | ILIDVSNNM | 16 |
| 175 | RQQVIELAR | 16 |
| 177 | QVIELARQL | 16 |
| 196 | SSAREIENL | 16 |
| 206 | LRLFTLWRG | 16 |
| 218 | VAISLATFE | 16 |
| 225 | FFFLYSFVR | 16 |
| 233 | RDVIHPYAR | 16 |
| 313 | AMVHVAYSL | 16 |
| 319 | YSLCLPMRR | 16 |
| 396 | STLGYVALL | 16 |
| 418 | AFEEEYYRF | 16 |
| 443 | ILDLLQLCR | 16 |
| 37 | GSGDFAKSL | 15 |
| 82 | ALTKTNIIF | 15 |
| 87 | NIIFVAIHR | 15 |
| 93 | IHREHYTSL | 15 |

TABLE XXIX-continued

V1-HLA-B2705-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 96 | EHYTSLWDL | 15 |
| 155 | QLGPKDASR | 15 |
| 173 | QARQQVIEL | 15 |
| 295 | LETWLQCRK | 15 |
| 297 | TWLQCRKQL | 15 |
| 329 | ERYLFLNMA | 15 |
| 390 | EFSFIQSTL | 15 |
| 401 | VALLISTFH | 15 |
| 409 | HVLIYGWKR | 15 |
| 411 | LIYGWKRAF | 15 |
| 438 | LPSIVILDL | 15 |
| 5 | SMMGSPKSL | 14 |
| 10 | PKSLSETCL | 14 |
| 18 | LPNGINGIK | 14 |
| 33 | VGVIGSGDF | 14 |
| 41 | FAKSLTIRL | 14 |
| 57 | VIGSRNPKF | 14 |
| 60 | SRNPKFASE | 14 |
| 77 | THHEDALTK | 14 |
| 120 | MRINQYPES | 14 |
| 128 | SNAEYLASL | 14 |
| 136 | LFPDSLIVK | 14 |
| 146 | FNVVSAWAL | 14 |
| 162 | SRQVYICSN | 14 |
| 167 | ICSNNIQAR | 14 |
| 193 | GSLSSAREI | 14 |
| 200 | EIENLPLRL | 14 |
| 201 | IENLPLRLF | 14 |
| 217 | VVAISLATF | 14 |
| 258 | TLPIVAITL | 14 |
| 261 | IVAITLLSL | 14 |
| 263 | AITLLSLVY | 14 |
| 267 | LSLVYLAGL | 14 |
| 280 | YQLYYGTKY | 14 |
| 281 | QLYYGTKYR | 14 |

TABLE XXIX-continued

V1-HLA-B2705-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 299 | LQCRKQLGL | 14 |
| 301 | CRKQLGLLS | 14 |
| 308 | LSFFFAMVH | 14 |
| 318 | AYSLCLPMR | 14 |
| 363 | FGIMSLGLL | 14 |
| 392 | SFIQSTLGY | 14 |
| 395 | QSTLGYVAL | 14 |
| 426 | FYTPPNFVL | 14 |
| 439 | PSIVILDLL | 14 |
| 444 | LDLLQLCRY | 14 |
| 35 | VIGSGDFAK | 13 |
| 98 | YTSLWDLRH | 13 |
| 99 | TSLWDLRHL | 13 |
| 103 | DLRIILLVGK | 13 |
| 113 | LIDVSNNMR | 13 |
| 117 | SNNMRINQY | 13 |
| 124 | QYPESNAEY | 13 |
| 129 | NAEYLASLF | 13 |
| 138 | PDSLIVKGF | 13 |
| 148 | VVSAWALQL | 13 |
| 151 | AWALQLGPK | 13 |
| 191 | DLGSLSSAR | 13 |
| 203 | NLPLRLFTL | 13 |
| 220 | ISLATFFFL | 13 |
| 229 | YSFVRDVIH | 13 |
| 239 | YARNQQSDF | 13 |
| 246 | DFYKIPIEI | 13 |
| 251 | PIEIVNKTL | 13 |
| 268 | SLVYLAGLL | 13 |
| 279 | AYQLYYGTK | 13 |
| 283 | YYGTKYRRF | 13 |
| 287 | KYRRFPPWL | 13 |
| 291 | FPPWLETWL | 13 |
| 300 | QCRKQLGLL | 13 |
| 304 | QLGLLSFFF | 13 |
| 306 | GLLSFFFAM | 13 |

TABLE XXIX-continued

V1-HLA-B2705-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 315 | VHVAYSLCL | 13 |
| 337 | AYQQVHANI | 13 |
| 348 | SWNEEEVWR | 13 |
| 371 | LSLLAVTSI | 13 |
| 378 | SIPSVSNAL | 13 |
| 388 | WREFSFIQS | 13 |
| 403 | LLISTFHVL | 13 |
| 408 | FHVLIYGWK | 13 |
| 435 | ALVLPSIVI | 13 |
| 17 | CLPNGINGI | 12 |
| 70 | FPHVVDVTH | 12 |
| 71 | PHVVDVTHH | 12 |
| 80 | EDALTKTNI | 12 |
| 86 | TNIIFVAIH | 12 |
| 89 | IFVAIHREH | 12 |
| 106 | HLLVGKILI | 12 |
| 114 | IDVSNNMRI | 12 |
| 133 | LASLFPDSL | 12 |
| 134 | ASLFPDSLI | 12 |
| 164 | QVYICSNNI | 12 |
| 184 | QLNFIPIDL | 12 |
| 187 | FIPIDLGSL | 12 |
| 205 | PLRLFTLWR | 12 |
| 219 | AISLATFFF | 12 |
| 231 | FVRDVIHPY | 12 |
| 232 | VRDVIHPYA | 12 |
| 256 | NKTLPIVAI | 12 |
| 272 | LAGLLAAAY | 12 |
| 288 | YRRFPPWLE | 12 |
| 317 | VAYSLCLPM | 12 |
| 322 | CLPMRRSER | 12 |
| 328 | SERYLFLNM | 12 |
| 349 | WNEEEVWRI | 12 |
| 352 | EEVWRIEMY | 12 |
| 362 | SFGIMSLGL | 12 |

TABLE XXIX-continued

V1-HLA-B2705-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 381 | SVSNALNWR | 12 |
| 383 | SNALNWREF | 12 |
| 385 | ALNWREFSF | 12 |
| 428 | TPPNFVLAL | 12 |

TABLE XXX

V2-HLA-B2705-9mers-98P4B6
Each peptide is a portion of SEQ ID NO: 5; each start position is specified, the length of peptide is 9 amino acids, and the end position for each peptide is the start position plus eight.

| Pos | 123456789 | score |
|---|---|---|
| 5 | GLQALSLSL | 17 |
| 9 | LSLSLSSGF | 15 |
| 15 | SGFTPFSCL | 15 |
| 1 | SGSPGLQAL | 14 |
| 3 | SPGLQALSL | 14 |
| 12 | SLSSGFTPF | 14 |
| 23 | LSLPSSWDY | 14 |
| 17 | FTPFSCLSL | 13 |
| 31 | YRCPPPCPA | 12 |
| 33 | GPPPCPADF | 12 |
| 34 | PPPCPADFF | 12 |
| 35 | PPCPADFFL | 12 |
| 24 | SLPSSWDYR | 11 |
| 37 | CPADFFLYF | 11 |
| 2 | GSPGLQALS | 9 |
| 36 | PCPADFFLY | 8 |

TABLE XXX

V5A-HLA-B2705-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 4 | LRLFTFWRG | 15 |
| 1 | NLPLRLFTF | 13 |

TABLE XXX-continued

V5A-HLA-B2705-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 3 | PLRLFTFWR | 11 |
| 5 | RLFTFWRGP | 7 |

TABLE XXX

V5B-HLA-B2705-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 2 | REFSFIQIF | 20 |
| 1 | WREFSFIQI | 19 |
| 5 | SFIQIFCSF | 16 |
| 22 | LEFVFLLTL | 16 |
| 24 | FVFLLTLLL | 16 |
| 12 | SFADTQTEL | 15 |
| 14 | ADTQTELEL | 15 |
| 18 | TELELEFVF | 15 |
| 23 | EFVFLLTLL | 15 |
| 16 | TQTELELEF | 14 |
| 20 | LELEFVFLL | 14 |
| 19 | ELELEFVFL | 13 |

TABLE XXX

V6-HLA-B2705-9mers-98P4B6
Each peptide is a portion of SEQ ID NO: 13; each start position is specified, the length of peptide is 9 amino acids, and the end position for each peptide is the start position plus eight.

| Pos | 123456789 | score |
|---|---|---|
| 23 | KRIKKGWEK | 29 |
| 19 | SRKLKRIKK | 25 |
| 6 | VILGKIILF | 19 |
| 13 | LFLPCISRK | 19 |
| 5 | IVILGKIIL | 18 |
| 7 | ILGKIILFL | 18 |
| 12 | ILFLPCISR | 18 |
| 16 | PCISRKLKR | 16 |
| 26 | KKGWEKSQF | 16 |

TABLE XXX-continued

V6-HLA-B2705-9mers-98P4B6
Each peptide is a portion of SEQ ID NO: 13; each start position is specified, the length of peptide is 9 amino acids, and the end position for each peptide is the start position plus eight.

| Pos | 123456789 | score |
|---|---|---|
| 2 | LPSIVILGK | 15 |
| 18 | ISRKLKRIK | 15 |
| 27 | KGWEKSQFL | 15 |
| 37 | EGIGGTIPH | 15 |
| 14 | FLPCISRKL | 14 |
| 42 | TIPHVSPER | 14 |

TABLE XXX

V7A-HLA-B2705-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 2 | PKSLSETFL | 14 |
| 1 | SPKSLSETF | 13 |
| 9 | FLPNGINGI | 12 |
| 6 | SETFLPNGI | 8 |
| 7 | ETFLPNGIN | 6 |
| 8 | TFLPNGING | 6 |

TABLE XXX

V7B-HLA-B2705-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 9 | STLGYVALL | 16 |
| 3 | NMAYQQSTL | 14 |
| 8 | QSTLGYVAL | 14 |
| 5 | AYQQSTLGY | 13 |
| 4 | MAYQQSTLG | 7 |

TABLE XXX

V7C-HLA-B2705-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 21  | KCLGANILR | 18 |
| 29  | RGGLSEIVL | 18 |
| 69  | AQESGIRNK | 18 |
| 167 | KLETIILSK | 18 |
| 175 | KLTQEQKSK | 18 |
| 74  | IRNKSSSSS | 17 |
| 125 | NGVGPLWEF | 17 |
| 128 | GPLWEFLLR | 17 |
| 107 | DRALKAANS | 16 |
| 131 | WEFLLRLLK | 16 |
| 5   | ILDLSVEVL | 15 |
| 20  | WKCLGANIL | 15 |
| 37  | LPIEWQQDR | 15 |
| 42  | QQDRKIPPL | 15 |
| 67  | AEAQESGIR | 15 |
| 100 | IDPPESPDR | 15 |
| 126 | GVGPLWEFL | 15 |
| 129 | PLWEFLLRL | 15 |
| 135 | LRLLKSQAA | 15 |
| 158 | EFLGSGTWM | 15 |
| 160 | LGSGTWMKL | 15 |
| 168 | LETIILSKL | 15 |
| 24  | GANILRGGL | 14 |
| 27  | ILRGGLSEI | 14 |
| 28  | LRGGLSEIV | 14 |
| 38  | PIEWQQDRK | 14 |
| 113 | ANSWRNPVL | 14 |
| 116 | WRNPVLPHT | 14 |
| 139 | KSQAASGTL | 14 |
| 141 | QAASGTLSL | 14 |
| 143 | ASGTLSLAF | 14 |
| 173 | LSKLTQEQK | 14 |
| 13  | LASPAAAWK | 13 |
| 31  | GLSEIVLPI | 13 |
| 44  | DRKIPPLST | 13 |
| 109 | ALKAANSWR | 13 |

TABLE XXX-continued

V7C-HLA-B2705-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 122 | PHTNGVGPL | 13 |
| 148 | SLAFTSWSL | 13 |
| 151 | FTSWSLGEF | 13 |
| 159 | FLGSGTWMK | 13 |
| 165 | WMKLETIIL | 13 |
| 176 | LTQEQKSKH | 13 |
| 181 | KSKHCMFSL | 13 |
| 39  | IEWQQDRKI | 12 |
| 102 | PPESPDRAL | 12 |
| 103 | PESPDRALK | 12 |
| 130 | LWEFLLRLL | 12 |
| 136 | RLLKSQAAS | 12 |
| 163 | GTWMKLETI | 12 |
| 178 | QEQKSKHCM | 12 |
| 19  | AWKCLGANI | 11 |
| 45  | RKIPPLSTP | 11 |
| 50  | LSTPPPPAM | 11 |
| 108 | RALKAANSW | 11 |
| 115 | SERNPVLPH | 11 |
| 127 | VGPLWEFLL | 11 |
| 152 | TSWSLGEFL | 11 |
| 157 | GEFLGSGTW | 11 |
| 164 | TWMKLETII | 11 |
| 179 | EQKSKHCMF | 11 |
| 15  | SPAAAWKCL | 10 |
| 30  | GGLSEIVLP | 10 |
| 76  | NKSSSSSQI | 10 |
| 92  | EDDEAQDSI | 10 |
| 75  | RNKSSSSSQ | 8 |
| 85  | PVVGVVTED | 8 |
| 145 | GTLSLAFTS | 8 |
| 171 | IILSKLTQE | 8 |
| 185 | CMFSLISGS | 8 |

TABLE XXX

V8-HLA-B2705-9mers-98P4B6
Each peptide is a portion of SEQ ID NO: 17; each start position is specified, the length of peptide is 9 amino acids, and the end position for each peptide is the start position plus eight.

| Pos | 123456789 | score |
|---|---|---|
| 7 | EGMGGTIPH | 13 |
| 1 | KSQFLEEGM | 11 |
| 5 | LEEGMGGTI | 9 |
| 8 | GMGGTIPHV | 9 |

TABLE XXX

V13-HLA-B2705-9mers-98P4B6
Each peptide is a portion of SEQ ID NO: 27; each start position is specified, the length of peptide is 9 amino acids, and the end position for each peptide is the start position plus eight.

| Pos | 123456789 | score |
|---|---|---|
| 2 | PKSLSETFL | 14 |
| 1 | SPKSLSETF | 13 |
| 9 | FLPNGINGI | 12 |
| 6 | SETFLPNGI | 8 |
| 7 | ETFLPNGTN | 6 |
| 8 | TFLPNGING | 6 |

TABLE XXX

V14-HLA-B2705-9mers-98P4B6
Each peptide is a portion of SEQ ID NO: 29; each start position is specified, the length of peptide is 9 amino acids, and the end position for each peptide is the start position plus eight.

| Pos | 123456789 | score |
|---|---|---|
| 4 | LRLFTFWRG | 15 |
| 1 | NLPLRLFTF | 13 |
| 3 | PLRLFTFWR | 11 |
| 5 | RLFTFWRGP | 7 |

TABLE XXX

V21-HLA-B2705-9mers-98P4B6
Each peptide is a portion of SEQ ID NO: 43; each start position is specified, the length of peptide is 9 amino acids, and the end position for each peptide is the start position plus eight.

| Pos | 123456789 | score |
|---|---|---|
| 2 | KLTQEQKTK | 18 |
| 3 | LTQEQKTKH | 14 |
| 8 | KTKHCMFSL | 13 |

TABLE XXX-continued

V21-HLA-B2705-9mers-98P4B6
Each peptide is a portion of SEQ ID NO: 43; each start position is specified, the length of peptide is 9 amino acids, and the end position for each peptide is the start position plus eight.

| Pos | 123456789 | score |
|---|---|---|
| 5 | QEQKTKHCM | 11 |
| 6 | EQKTKHCMF | 11 |

TABLE XXX

V25-HLA-B2705-9mers-98P4B6
Each peptide is a portion of SEQ ID NO: 51; each start position is specified, the length of peptide is 9 amino acids, and the end position for each peptide is the start position plus eight.

| Pos | 123456789 | score |
|---|---|---|
| 2 | LFLPCISQK | 18 |
| 5 | PCISQKLKR | 16 |
| 7 | ISQKLKRIK | 15 |
| 8 | SQKLKRIKK | 15 |
| 3 | FLPCISQKL | 14 |
| 4 | LPCISQKLK | 13 |
| 6 | CISQKLKRI | 12 |
| 9 | QKLKRIKKG | 9 |
| 1 | ILFLPCISQ | 8 |

TABLE XXXI

V1-HLA-B2709-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 326 | RRSERYLFL | 25 |
| 198 | AREIENLPL | 22 |
| 424 | YRFYTPPNF | 22 |
| 212 | WRGPVVVAI | 21 |
| 28 | ARKVTVGVI | 20 |
| 50 | IRCGYHVVI | 20 |
| 325 | MRRSERYLF | 20 |
| 104 | LRHLLVGKI | 19 |
| 182 | ARQLNFIPI | 19 |
| 355 | WRIEMYISF | 18 |
| 274 | GLLAAAYQL | 18 |
| 289 | RRFPPWLET | 18 |

TABLE XXXI-continued

V1-HLA-B2709-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 105 | RHLLVGKIL | 16 |
| 193 | GSLSSAREI | 15 |
| 214 | GPVVVAISL | 15 |
| 441 | IVILDLLQL | 15 |
| 37 | GSGDFAKSL | 14 |
| 39 | GDFAKSLTI | 14 |
| 48 | RLIRCGYHV | 14 |
| 264 | ITLLSLVYL | 14 |
| 306 | GLLSFFFAM | 14 |
| 313 | AMVHVAYSL | 14 |
| 425 | RFYTPPNFV | 14 |
| 430 | PNFVLALVL | 14 |
| 436 | LVLPSIVIL | 14 |
| 47 | IRLIRGGYH | 13 |
| 61 | RNPKFASEF | 13 |
| 68 | EFFPHVVDV | 13 |
| 99 | TSLWDLRHL | 13 |
| 135 | SLFPDSLIV | 13 |
| 148 | VVSAWALQL | 13 |
| 177 | QVIELARQL | 13 |
| 179 | IELARQLNF | 13 |
| 206 | LRLFTLWRG | 13 |
| 220 | ISLATFFFL | 13 |
| 287 | KYRRFPPWL | 13 |
| 297 | TWLQCRKQL | 13 |
| 302 | RKQLGLLSF | 13 |
| 396 | STLGYVALL | 13 |
| 41 | FAKSLTIRL | 12 |
| 85 | KTNIIFVAI | 12 |
| 96 | EHYTSLWDL | 12 |
| 114 | IDVSNNMRI | 12 |
| 120 | MRTNQYPES | 12 |
| 125 | YPESNAEYL | 12 |
| 146 | FNVVSAWAL | 12 |
| 157 | GPKDASRQV | 12 |
| 159 | KDASRQVYI | 12 |

TABLE XXXI-continued

V1-HLA-B2709-9mers-98P4B6
Each peptide is a portion of SEQ ID NO: 3; each start position is specified, the length of peptide is 9 amino acids, and the end position for each peptide is the start position plus eight.

| Pos | 123456789 | score |
|---|---|---|
| 200 | EIENLPLRL | 12 |
| 223 | ATFFFLYSF | 12 |
| 227 | FLYSFVRDV | 12 |
| 232 | VRDVIHPYA | 12 |
| 261 | IVAITLLSL | 12 |
| 267 | LSLVYLAGL | 12 |
| 268 | SLVYLAGLL | 12 |
| 303 | KQLGLLSFF | 12 |
| 315 | VHVAYSLCL | 12 |
| 317 | VAYSLCLPM | 12 |
| 329 | ERYLFLNMA | 12 |
| 365 | IMSLGLLSL | 12 |
| 366 | MSLGLLSLL | 12 |
| 395 | QSTLGYVAL | 12 |
| 403 | LLISTFHVL | 12 |
| 416 | KRAFEEEYY | 12 |
| 426 | FYTPPNFVL | 12 |
| 428 | TPPNFVLAL | 12 |
| 439 | PSIVILDLL | 12 |

TABLE XXXI

V2-HLA-B2709-9mers-98P4B6
Each peptide is a portion of SEQ ID NO: 5; each start position is specified, the length of peptide is 9 amino acids, and the end position for each peptide is the start position plus eight.

| Pos | 123456789 | score |
|---|---|---|
| 5 | GLQALSLSL | 14 |
| 3 | SPGLQALSL | 12 |
| 15 | SGFTPFSCL | 12 |
| 1 | SGSPGLQAL | 11 |
| 9 | LSLSLSSGF | 11 |
| 17 | FTPFSCLSL | 11 |
| 31 | YRCPPPCPA | 11 |
| 35 | PPCPADFFL | 11 |
| 12 | SLSSGFTPF | 9 |
| 33 | CPPPCPADF | 9 |

TABLE XXXI-continued

V2-HLA-B2709-9mers-98P4B6
Each peptide is a portion of SEQ ID NO: 5; each start position is specified, the length of peptide is 9 amino acids, and the end position for each peptide is the start position plus eight.

| Pos | 123456789 | score |
|---|---|---|
| 34 | PPPCPADFF | 9 |
| 37 | CPADFFLYF | 9 |
| 32 | RCPPPCPAD | 6 |

TABLE XXXI

V5A-HLA-B2709-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 4 | LRLFTFWRG | 13 |
| 7 | FTFWRGPVV | 11 |
| 6 | LFTFWRGPV | 9 |
| 8 | TFWRGPVVV | 9 |
| 1 | NLPLRLFTF | 8 |
| 5 | RLFTFWRGP | 6 |

TABLE XXXI

V5B-HLA-B2709-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 1 | WREFSFIQI | 19 |
| 2 | REFSFIQIF | 15 |
| 14 | ADTQTELEL | 13 |
| 20 | LELEFVFLL | 13 |
| 22 | LEFVFLLTL | 13 |
| 24 | FVFLLTLLL | 13 |
| 19 | ELELEFVFL | 11 |
| 23 | EFVFLLTLL | 11 |
| 5 | SFIQIFCSF | 10 |
| 12 | SFADTQTEL | 10 |

TABLE XXXI-continued

V5B-HLA-B2709-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 16 | TQTELELEF | 10 |
| 18 | TELELEFVF | 10 |

TABLE XXXI

V6-HLA-B2709-9mers-98P4B6
Each peptide is a portion of SEQ ID NO: 13; each start position is specified, the length of peptide is 9 amino acids, and the end position for each peptide is the start position plus eight.

| Pos | 123456789 | score |
|---|---|---|
| 7 | ILGKIILFL | 13 |
| 23 | KRIKKGWEK | 13 |
| 5 | IVILGKIIL | 12 |
| 10 | KIILFLPCI | 12 |
| 27 | KGWEKSQFL | 12 |
| 38 | GIGGTIPHV | 12 |
| 14 | FLPCISRKL | 11 |
| 26 | KKGWEKSQF | 11 |
| 3 | PSIVILGKI | 10 |
| 6 | VILGKIILF | 10 |
| 19 | SRKLKRIKK | 10 |
| 31 | KSQFLEEGI | 10 |
| 43 | IPHVSPERV | 10 |
| 45 | HVSPERVTV | 10 |
| 4 | SIVILGKII | 9 |
| 17 | CISRKLKRI | 9 |
| 35 | LEEGIGGTI | 9 |
| 46 | VSPERVTVM | 9 |
| 20 | RKLKRIKKG | 6 |
| 41 | GTIPHVSPE | 6 |

TABLE XXXI

V7A-HLA-B2709-
9mers-98P4B6
Each peptide is a portion of
SEQ ID NO: 15; each start
position is specified, the
length of peptide is 9 amino
acids, and the end position
for each peptide is the start
position plus eight.

| Pos | 123456789 | score |
|---|---|---|
| 2 | PKSLSETFL | 10 |
| 1 | SPKSLSETF | 9 |
| 6 | SETFLPNGI | 9 |
| 9 | FLPNGINGI | 8 |
| 3 | KSLSETFLP | 5 |
| 8 | TFLPNGING | |

TABLE XXXI

V7B-HLA-B2709-
9mers-98P4B6
Each peptide is a portion of
SEQ ID NO: 15; each start
position is specified, the
length of peptide is 9 amino
acids, and the end position
for each peptide is the start
position plus eight.

| Pos | 123456789 | score |
|---|---|---|
| 9 | STLGYVALL | 13 |
| 8 | QSTLGYVAL | 12 |
| 3 | NMAYQQSTL | 10 |
| 6 | YQQSTLGYV | 9 |

TABLE XXXI

V7C-HLA-B2709-
9mers-98P4B6
Each peptide is a portion of
SEQ ID NO: 15; each start
position is specified, the
length of peptide is 9 amino
acids, and the end position
for each peptide is the start
position plus eight.

| Pos | 123456789 | score |
|---|---|---|
| 28 | LRGGLSEIV | 18 |
| 29 | RGGLSEIVL | 14 |
| 31 | GLSEIVLPI | 14 |
| 126 | GVGPLWEFL | 14 |
| 24 | GANILRGGL | 13 |
| 5 | ILDLSVEVL | 12 |
| 107 | DRALKAANS | 12 |

TABLE XXXI-continued

V7C-HLA-B2709-
9mers-98P4B6
Each peptide is a portion of
SEQ ID NO: 15; each start
position is specified, the
length of peptide is 9 amino
acids, and the end position
for each peptide is the start
position plus eight.

| Pos | 123456789 | score |
|---|---|---|
| 113 | ANSWRNPVL | 12 |
| 116 | WRNPVLPHT | 12 |
| 122 | PHTNGVGPL | 12 |
| 129 | PLWEFLLRL | 12 |
| 135 | LRLLKSQAA | 12 |
| 139 | KSQAASGTL | 12 |
| 141 | QAASGTLSL | 12 |
| 168 | LETIILSKL | 12 |
| 181 | KSKHCMFSL | 12 |
| 4 | VILDLSVEV | 11 |
| 20 | WKCLGANIL | 11 |
| 42 | QQDRKIPPL | 11 |
| 44 | DRKIPPLST | 11 |
| 50 | LSTPPPPAM | 11 |
| 74 | IRNKSSSSS | 11 |
| 82 | SQIPVVGVV | 11 |
| 102 | PPESPDRAL | 11 |
| 119 | PVLPHTNGV | 11 |
| 152 | TSWSLGEFL | 11 |
| 163 | GTWMKLETI | 11 |
| 2 | SIVILDLSV | 10 |
| 15 | SPAAAWKCL | 10 |
| 19 | AWKCLGANI | 10 |
| 76 | NKSSSSSQI | 10 |
| 79 | SSSSQIPVV | 10 |
| 81 | SSQIPVVGV | 10 |
| 112 | AANSWRNPV | 10 |
| 127 | VGPLWEFLL | 10 |
| 130 | LWEFLLRLL | 10 |
| 143 | ASGTLSLAF | 10 |
| 148 | SLAFTSWSL | 10 |
| 158 | EFLGSGTWM | 10 |
| 160 | LGSGTWMKL | 10 |
| 165 | WMKLETIIL | 10 |

TABLE XXXI-continued

V7C-HLA-B2709-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 27 | ILRGGLSEI | 9 |
| 39 | IEWQQDRKI | 9 |
| 78 | SSSSSQIPV | 9 |
| 125 | NGVGPLWEF | 9 |
| 179 | EQKSKHCMF | 9 |
| 66 | TAEAQESGI | 8 |
| 92 | EDDEAQDSI | 8 |
| 151 | FTSWSLGEF | 8 |
| 164 | TWMKLETII | 8 |
| 178 | QEQKSKHCM | 8 |
| 182 | SKHCMFSLI | 8 |

TABLE XXXI

V8-HLA-B2709-9mers-98P4B6
Each peptide is a portion of SEQ ID NO: 17; each start position is specified, the length of peptide is 9 amino acids, and the end position for each peptide is the start position plus eight.

| Pos | 123456789 | score |
|---|---|---|
| 8 | GMGGTIPHV | 12 |
| 1 | KSQFLEEGM | 10 |
| 5 | LEEGMGGTI | 8 |

TABLE XXXI

V13-HLA-B2709-9mers-98P4B6
Each peptide is a portion of SEQ ID NO: 27; each start position is specified, the length of peptide is 9 amino acids, and the end position for each peptide is the start position plus eight.

| Pos | 123456789 | score |
|---|---|---|
| 2 | PKSLSETFL | 10 |
| 1 | SPKSLSETF | 9 |
| 6 | SETFLPNGI | 9 |
| 9 | FLPNGINGI | 8 |
| 3 | KSLSETFLP | 5 |
| 8 | TFLPNGING | 4 |

TABLE XXXI

V14-HLA-B2709-9mers-98P4B6
Each peptide is a portion of SEQ ID NO: 29; each start position is specified, the length of peptide is 9 amino acids, and the end position for each peptide is the start position plus eight.

| Pos | 123456789 | score |
|---|---|---|
| 4 | LRLFTFWRG | 13 |
| 7 | FTFWRGPVV | 11 |
| 6 | LFTFWRGPV | 9 |
| 8 | TFWRGPVVV | 9 |
| 1 | NLPLRLFTF | 8 |
| 5 | RLFTFWRGP | 6 |

TABLE XXXI

V21-HLA-B2709-9mers-98P4B6
Each peptide is a portion of SEQ ID NO: 43; each start position is specified, the length of peptide is 9 amino acids, and the end position for each peptide is the start position plus eight.

| Pos | 123456789 | score |
|---|---|---|
| 8 | KTKHCMFSL | 12 |
| 5 | QEQKTKHCM | 8 |
| 6 | EQKTKHCMF | 8 |
| 9 | TKHCMFSLI | 8 |

TABLE XXXI

V25-HLA-B2709-
9mers-98P4B6
Each peptide is a portion of
SEQ ID NO: 51; each start
position is specified, the
length of peptide is 9 amino
acids, and the end position
for each peptide is the start
position plus eight.

| Pos | 123456789 | score |
|---|---|---|
| 3 | FLPCISQKL | 11 |
| 6 | CISQKLKRI | 9 |
| 2 | LFLPCISQK | 4 |

TABLE XXXII

V1-HLA-B4402-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|---|---|---|
| 352 | EEVWRIEMY | 26 |
| 201 | IENLPLRLF | 24 |
| 179 | IELARQLNF | 23 |
| 14 | SETCLPNGI | 21 |
| 419 | FEEEYYRFY | 21 |
| 357 | IEMYISFGI | 20 |
| 42 | AKSLTIRLI | 18 |
| 436 | LVLPSIVIL | 18 |
| 117 | SNNMRINQY | 17 |
| 144 | KGFNVVSAW | 17 |
| 259 | LPIVAITLL | 17 |
| 441 | IVILDLLQL | 17 |
| 5 | SMMGSPKSL | 16 |
| 138 | PDSLIVKGF | 16 |
| 177 | QVIELARQL | 16 |
| 199 | REIENLPLR | 16 |
| 203 | NLPLRLFTL | 16 |
| 219 | AISLATFFF | 16 |
| 223 | ATFFFLYSF | 16 |
| 256 | NKTLPIVAI | 16 |
| 263 | AITLLSLVY | 16 |
| 290 | RFPPWLETW | 16 |

TABLE XXXII-continued

V1-HLA-B4402-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|---|---|---|
| 392 | SFIQSTLGY | 16 |
| 403 | LLISTFHVL | 16 |
| 428 | TPPNFVLAL | 16 |
| 439 | PSIVILDLL | 16 |
| 67 | SEFFPHVVD | 15 |
| 79 | HEDALTKTN | 15 |
| 100 | SLWDLRHLL | 15 |
| 130 | AEYLASLFP | 15 |
| 182 | ARQLNFIPI | 15 |
| 196 | SSAREIENL | 15 |
| 200 | EIENLPLRL | 15 |
| 212 | WRGPVVVAI | 15 |
| 231 | FVRDVIHPY | 15 |
| 252 | IEIVNKTLP | 15 |
| 297 | TWLQCRKQL | 15 |
| 363 | FGIMSLGLL | 15 |
| 378 | SIPSVSNAL | 15 |
| 389 | REFSFIQST | 15 |
| 390 | EFSFIQSTL | 15 |
| 396 | STLGYVALL | 15 |
| 400 | YVALLISTF | 15 |
| 421 | EEYYRFYTP | 15 |
| 430 | PNFVLALVL | 15 |
| 438 | LPSIVILDL | 15 |
| 17 | CLPNGINGI | 14 |
| 37 | GSGDFAKSL | 14 |
| 82 | ALTKTNIIF | 14 |
| 85 | KTNIIFVAI | 14 |
| 96 | EHYTSLWDL | 14 |
| 105 | RHLLVGKIL | 14 |
| 148 | VVSAWALQL | 14 |
| 198 | AREIENLPL | 14 |
| 204 | LPLRLFTLW | 14 |
| 218 | VAISLATFF | 14 |

TABLE XXXII-continued

V1-HLA-B4402-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|---|---|---|
| 221 | SLATFFFLY | 14 |
| 258 | TLPIVAITL | 14 |
| 264 | ITLLSLVYL | 14 |
| 272 | LAGLLAAAY | 14 |
| 303 | KQLGLLSFF | 14 |
| 313 | AMVHVAYSL | 14 |
| 351 | EEEVWRIEM | 14 |
| 355 | WRIEMYISF | 14 |
| 360 | YISFGIMSL | 14 |
| 365 | IMSLGLLSL | 14 |
| 366 | MSLGLLSLL | 14 |
| 383 | SNALNWREF | 14 |
| 385 | ALNWREFSF | 14 |
| 395 | QSTLGYVAL | 14 |
| 411 | LIYGWKRAF | 14 |
| 426 | FYTPPNFVL | 14 |
| 435 | ALVLPSIVI | 14 |
| 28 | ARKVTVGVI | 13 |
| 46 | TIRLIRCGY | 13 |
| 99 | TSLWDLRHL | 13 |
| 126 | PESNAEYLA | 13 |
| 129 | NAEYLASLF | 13 |
| 133 | LASLFPDSL | 13 |
| 134 | ASLFPDSLI | 13 |
| 146 | FNVVSAWAL | 13 |
| 158 | PKDASRQVY | 13 |
| 180 | ELARQLNFI | 13 |
| 184 | QLNFIPIDL | 13 |
| 240 | ARNQQSDFY | 13 |
| 251 | PIEIVNKTL | 13 |
| 253 | EIVNKTLPI | 13 |
| 268 | SLVYLAGLL | 13 |
| 274 | GLLAAAYQL | 13 |

TABLE XXXII-continued

V1-HLA-B4402-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|---|---|---|
| 286 | TKYRRFPPW | 13 |
| 287 | KYRRFPPWL | 13 |
| 302 | RKQLGLLSF | 13 |
| 311 | FFAMVHVAY | 13 |
| 323 | LPMRRSERY | 13 |
| 326 | RRSERYLFL | 13 |
| 328 | SERYLFLNM | 13 |
| 330 | RYLFLNMAY | 13 |
| 341 | VHANIENSW | 13 |
| 347 | NSWNEEEVW | 13 |
| 380 | PSVSNALNW | 13 |
| 407 | TFHVLIYGW | 13 |
| 418 | AFEEEYYRF | 13 |
| 420 | EEEYYRFYT | 13 |
| 424 | YRFYTPPNF | 13 |
| 444 | LDLLQLCRY | 13 |
| 10 | PKSLSETCL | 12 |
| 39 | GDFAKSLTI | 12 |
| 41 | FAKSLTIRL | 12 |
| 57 | VIGSRNPKF | 12 |
| 61 | RNPKFASEF | 12 |
| 75 | DVTHHEDAL | 12 |
| 81 | DALTKTNII | 12 |
| 94 | HREHYTSLW | 12 |
| 125 | YPESNAEYL | 12 |
| 128 | SNAEYLASL | 12 |
| 173 | QARQQVIEL | 12 |
| 187 | FIPIDLGSL | 12 |
| 214 | GPVVVAISL | 12 |
| 217 | VVAISLATF | 12 |
| 220 | ISLATFFFL | 12 |
| 261 | IVAITLLSL | 12 |
| 267 | LSLVYLAGL | 12 |
| 280 | YQLYYGTKY | 12 |

TABLE XXXII-continued

V1-HLA-B4402-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|---|---|---|
| 283 | YYGTKYRRF | 12 |
| 299 | LQCRKQLGL | 12 |
| 300 | QCRKQLGLL | 12 |
| 324 | PMRRSERYL | 12 |
| 325 | MRRSERYLF | 12 |
| 350 | NEEEVWRIE | 12 |
| 353 | EVWRIEMYI | 12 |
| 362 | SFGIMSLGL | 12 |
| 404 | LISTFHVLI | 12 |
| 405 | ISTFHVLIY | 12 |

TABLE XXXII

V2-HLA-B4402-
9mers-98P4B6
Each peptide is a portion of
SEQ ID NO: 5; each start
position is specified, the
length of peptide is 9 amino
acids, and the end position
for each peptide is the start
position plus eight.

| Pos | 123456789 | score |
|---|---|---|
| 1 | SGSPGLQAL | 18 |
| 15 | SGFTPFSCL | 15 |
| 33 | CPPPCPADF | 15 |
| 3 | SPGLQALSL | 14 |
| 23 | LSLPSSWDY | 14 |
| 12 | SLSSGFTPF | 13 |
| 21 | SCLSLPSSW | 13 |
| 35 | PPCPADFFL | 13 |
| 36 | PCPADFFLY | 13 |
| 37 | CPADFFLYF | 13 |
| 17 | FTPFSCLSL | 12 |
| 34 | PPPCPADFF | 12 |
| 5 | GLQALSLSL | 11 |
| 9 | LSLSLSSGF | 11 |

TABLE XXXII

V5A-HLA-B4402-
9mers-98P4B6
Each peptide is a portion of
SEQ ID NO: 11; each start
position is specified, the
length of peptide is 9 amino
acids, and the end position
for each peptide is the start
position plus eight.

| Pos | 123456789 | score |
|---|---|---|
| 1 | NLPLRLFTF | 16 |
| 2 | LPLRLFTFW | 13 |

TABLE XXXII

V5B-HLA-B4402-
9mers-98P4B6
Each peptide is a portion of
SEQ ID NO: 11; each start
position is specified, the
length of peptide is 9 amino
acids, and the end position
for each peptide is the start
position plus eight.

| Pos | 123456789 | score |
|---|---|---|
| 2 | REFSFIQIF | 25 |
| 22 | LEFVFLLTL | 25 |
| 20 | LELEFVFLL | 23 |
| 18 | TELELEFVF | 22 |
| 5 | SFIQIFCSF | 16 |
| 24 | FVFLLTLLL | 16 |
| 19 | ELELEFVFL | 15 |
| 14 | ADTQTELEL | 14 |
| 23 | EFVFLLTLL | 14 |
| 12 | SFADTQTEL | 12 |

TABLE XXXII

V6-HLA-B4402-
9mers-98P4B6
Each peptide is a portion of
SEQ ID NO: 13; each start
position is specified, the
length of peptide is 9 amino
acids, and the end position
for each peptide is the start
position plus eight.

| Pos | 123456789 | score |
|---|---|---|
| 35 | LEEGIGGTI | 21 |
| 6 | VILGKIILF | 17 |
| 5 | IVILGKIIL | 15 |
| 7 | ILGKIILFL | 15 |
| 21 | KLKRIKKGW | 15 |

TABLE XXXII-continued

V6-HLA-B4402-
9mers-98P4B6
Each peptide is a portion of
SEQ ID NO: 13; each start
position is specified, the
length of peptide is 9 amino
acids, and the end position
for each peptide is the start
position plus eight.

| Pos | 123456789 | score |
|---|---|---|
| 3 | PSIVILGKI | 14 |
| 10 | KIILFLPCI | 14 |
| 14 | FLPCISRKL | 14 |
| 17 | CISRKLKRI | 13 |
| 26 | KKGWEKSQF | 12 |
| 29 | WEKSQFLEE | 12 |
| 36 | EEGIGGTIP | 12 |
| 4 | SIVILGKII | 11 |
| 27 | KGWEKSQFL | 11 |

TABLE XXXII

V7A-HLA-B4402-
9mers-98P4B6
Each peptide is a portion of
SEQ ID NO: 15; each start
position is specified, the
length of peptide is 9 amino
acids, and the end position
for each peptide is the start
position plus eight.

| Pos | 123456789 | score |
|---|---|---|
| 6 | SETFLPNGI | 21 |
| 9 | FLPNGINGI | 14 |
| 1 | SPKSLSETF | 12 |
| 2 | PKSLSETFL | 12 |

TABLE XXXII

V7B-HLA-B4402-
9mers-98P4B6
Each peptide is a portion of
SEQ ID NO: 15; each start
position is specified, the
length of peptide is 9 amino
acids, and the end position
for each peptide is the start
position plus eight.

| Pos | 123456789 | score |
|---|---|---|
| 5 | AYQQSTLGY | 15 |
| 9 | STLGYVALL | 15 |
| 8 | QSTLGYVAL | 14 |
| 3 | NMAYQQSTL | 12 |

TABLE XXXII

V7C-HLA-B4402-
9mers-98P4B6
Each peptide is a portion of
SEQ ID NO: 15; each start
position is specified, the
length of peptide is 9 amino
acids, and the end position
for each peptide is the start
position plus eight.

| Pos | 123456789 | score |
|---|---|---|
| 33 | SEIVLPIEW | 26 |
| 157 | GEFLGSGTW | 24 |
| 168 | LETIILSKL | 23 |
| 39 | IEWQQDRKI | 20 |
| 143 | ASGTLSLAF | 17 |
| 51 | STPPPPAMW | 16 |
| 70 | QESGIRNKS | 16 |
| 103 | PESPDRALK | 16 |
| 113 | ANSWRNPVL | 16 |
| 131 | WEFLLRLLK | 16 |
| 42 | QQDRKIPPL | 15 |
| 5 | ILDLSVEVL | 14 |
| 61 | EEAGATAEA | 14 |
| 10 | VEVLASPAA | 13 |
| 12 | VLASPAAAW | 13 |
| 15 | SPAAAWKCL | 13 |
| 20 | WKCLGANIL | 13 |
| 29 | RGGLSEIVL | 13 |
| 60 | TEEAGATAE | 13 |
| 67 | AEAQESGIR | 13 |
| 91 | TEDDEAQDS | 13 |
| 102 | PPESPDRAL | 13 |
| 108 | RALKAANSW | 13 |
| 125 | NGVGPLWEF | 13 |
| 126 | GVGPLWEFL | 13 |
| 127 | VGPLWEFLL | 13 |
| 130 | LWEFLLRLL | 13 |
| 146 | TLSLAFTSW | 13 |
| 160 | LGSGTWMKL | 13 |
| 165 | WMKLETIIL | 13 |
| 31 | GLSEIVLPI | 12 |
| 122 | PHTNGVGPL | 12 |
| 123 | HTNGVGPLW | 12 |
| 129 | PLWEFLLRL | 12 |

TABLE XXXII-continued

V7C-HLA-B4402-
9mers-98P4B6
Each peptide is a portion of
SEQ ID NO: 15; each start
position is specified, the
length of peptide is 9 amino
acids, and the end position
for each peptide is the start
position plus eight.

| Pos | 123456789 | score |
|---|---|---|
| 139 | KSQAASGTL | 12 |
| 141 | QAASGTLSL | 12 |
| 151 | FTSWSLGEF | 12 |
| 179 | EQKSKHCMF | 12 |

TABLE XXXII

V8-HLA-B4402-9mers-98P4B6
Each peptide is a portion of SEQ ID NO: 17;
each start position is specified, the
length of peptide is 9 amino acids, and the
end position for each peptide is the start
position plus eight.

| Pos | 123456789 | score |
|---|---|---|
| 5 | LEEGMGGTI | 20 |
| 6 | EEGMGGTIP | 12 |

TABLE XXXII

V13-HLA-B4402-9mers-98P4B6
Each peptide is a portion of SEQ ID NO: 27;
each start position is specified, the
length of peptide is 9 amino acids, and the
end position for each peptide is the start
position plus eight.

| Pos | 123456789 | score |
|---|---|---|
| 6 | SETFLPNGI | 21 |
| 9 | FLPNGINGI | 14 |
| 1 | SPKSLSETF | 12 |
| 2 | PKSLSETFL | 72 |

TABLE XXXII

V14-HLA-B4402-9mers-98P4B6
Each peptide is a portion of SEQ ID NO: 29;
each start position is specified, the
length of peptide is 9 amino acids, and the
end position for each peptide is the start
position plus eight.

| Pos | 123456789 | score |
|---|---|---|
| 1 | NLPLRLFTF | 16 |
| 2 | LPLRLFTFW | 13 |

TABLE XXXII

V21-HLA-B4402-9mers-98P4B6
Each peptide is a portion of SEQ ID NO: 43;
each start position is specified, the
length of peptide is 9 amino acids, and the
end position for each peptide is the start
position plus eight.

| Pos | 123456789 | score |
|---|---|---|
| 6 | EQKTKHCMF | 13 |
| 5 | QEQKTKHCM | 11 |
| 8 | KTKHCMFSL | 11 |
| 9 | TKHCMFSLI | 10 |

TABLE XXXII

V25-HLA-B4402-9mers-98P4B6
Each peptide is a portion of SEQ ID NO: 51;
each start position is specified, the
length of peptide is 9 amino acids, and the
end position for each peptide is the start
position plus eight.

| Pos | 123456789 | score |
|---|---|---|
| 3 | FLPCISQKL | 13 |
| 6 | CISQKLKRI | 12 |
| 2 | LFLPCISQK | 8 |
| 9 | QKLKRIKKG | 8 |

TABLE XXXIIII

V1-HLA-B5101-
9mers-98P4B6
Each peptide is a portion of
SEQ ID NO: 3; each start
position is specified, the
length of peptide is 9 amino
acids, and the end position
for each peptide is the start
position plus eight.

| Pos | 123456789 | score |
|---|---|---|
| 81 | DALTKTNII | 29 |
| 27 | DARKVTVGV | 26 |
| 65 | FASEFFPHV | 23 |
| 374 | LAVTSIPSV | 23 |
| 434 | LALVLPSIV | 23 |
| 438 | LPSIVILDL | 22 |
| 246 | DFYKIPIEI | 21 |
| 262 | VAITLLSLV | 21 |
| 368 | LGLLSLLAV | 21 |
| 428 | TPPNFVLAL | 21 |
| 429 | PPNFVLALV | 21 |
| 23 | NGIKDARKV | 20 |

TABLE XXXIIII-continued

V1-HLA-B5101-9mers-98P4B6
Each peptide is a portion of SEQ ID NO: 3; each start position is specified, the length of peptide is 9 amino acids, and the end position for each peptide is the start position plus eight.

| Pos | 123456789 | score |
|-----|-----------|-------|
| 157 | GPKDASRQV | 20 |
| 214 | GPVVVAISL | 20 |
| 259 | LPIVAITLL | 20 |
| 41  | FAKSLTIRL | 19 |
| 125 | YPESNAEYL | 19 |
| 133 | LASLFPDSL | 19 |
| 173 | QARQQVIEL | 19 |
| 250 | IPIEIVNKT | 19 |
| 291 | FPPWLETWL | 19 |
| 50  | IRCGYHVVI | 18 |
| 228 | LYSFVRDVI | 17 |
| 336 | MAYQQVHAN | 17 |
| 371 | LSLLAVTSI | 17 |
| 28  | ARKVTVGVI | 16 |
| 39  | GDFAKSLTI | 16 |
| 70  | FPHVVDVTH | 16 |
| 104 | LRHLLVGKI | 16 |
| 141 | LIVKGFNVV | 16 |
| 160 | DASRQVYIC | 16 |
| 204 | LPLRLFTLW | 16 |
| 227 | FLYSFVRDV | 16 |
| 237 | HPYARNQQS | 16 |
| 317 | VAYSLCLPM | 16 |
| 52  | CGYHVVIGS | 15 |
| 137 | FPDSLIVKG | 15 |
| 164 | QVYICSNNI | 15 |
| 171 | NIQARQQVI | 15 |
| 193 | GSLSSAREI | 15 |
| 210 | TLWRGPVVV | 15 |
| 212 | WRGPVVVAI | 15 |
| 276 | LAAAYQLYY | 15 |
| 349 | WNEEEVWRI | 15 |
| 363 | FGIMSLGLL | 15 |
| 397 | TLGYVALLI | 15 |

TABLE XXXIIII-continued

V1-HLA-B5101-9mers-98P4B6
Each peptide is a portion of SEQ ID NO: 3; each start position is specified, the length of peptide is 9 amino acids, and the end position for each peptide is the start position plus eight.

| Pos | 123456789 | score |
|-----|-----------|-------|
| 425 | RFYTPPNFV | 15 |
| 18  | LPNGINGIK | 14 |
| 25  | IKDARKVTV | 14 |
| 114 | IDVSNNMRI | 14 |
| 152 | WALQLGPKD | 14 |
| 209 | FTLWRGPVV | 14 |
| 222 | LATFFFLYS | 14 |
| 242 | NQQSDFYKI | 14 |
| 258 | TLPIVAITL | 14 |
| 278 | AAYQLYYGT | 14 |
| 379 | IPSVSNALN | 14 |
| 386 | LNWREFSFI | 14 |
| 398 | LGYVALLIS | 14 |
| 401 | VALLISTFH | 14 |
| 404 | LISTFHVLI | 14 |
| 433 | VLALVLPSI | 14 |
| 435 | ALVLPSIVI | 14 |

TABLE XXXIIII

V2-HLA-B5101-9mers-98P4B6
Each peptide is a portion of SEQ ID NO: 5; each start position is specified, the length of peptide is 9 amino acids, and the end position for each peptide is the start position plus eight.

| Pos | 123456789 | score |
|-----|-----------|-------|
| 3   | SPGLQALSL | 18 |
| 35  | PPCPADFFL | 16 |
| 15  | SGFTPFSCL | 15 |
| 1   | SGSPGLQAL | 13 |
| 7   | QALSLSLSS | 13 |
| 18  | TPFSCLSLP | 13 |
| 25  | LPSSWDYRC | 13 |
| 37  | CPADFFLYF | 13 |
| 33  | CPPPCPADF | 12 |

TABLE XXXIIII-continued

V2-HLA-B5101-9mers-98P4B6
Each peptide is a portion of SEQ ID NO: 5; each start position is specified, the length of peptide is 9 amino acids, and the end position for each peptide is the start position plus eight.

| Pos | 123456789 | score |
|---|---|---|
| 34 | PPPCPADFF | 12 |
| 17 | FTPFSCLSL | 10 |
| 4 | PGLQALSLS | 9 |
| 5 | GLQALSLSL | 8 |

TABLE XXXIIII

V5A-HLA-B5101-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 2 | LPLRLFTFW | 16 |
| 8 | TFWRGPVVV | 15 |
| 7 | FTFWRGPVV | 13 |
| 6 | LFTFWRGPV | 10 |
| 9 | FWRGPVVVA | 8 |
| 4 | LRLFTFWRG | 7 |

TABLE XXXIIII

V5B-HLA-B5101-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 20 | LELEFVFLL | 14 |
| 1 | WREFSFIQI | 13 |
| 22 | LEFVFLLTL | 13 |
| 13 | FADTQTELE | 12 |
| 12 | SFADTQTEL | 9 |
| 17 | QTELELEFV | 9 |
| 24 | FVFLLTLLL | 9 |
| 14 | ADTQTELEL | 8 |
| 18 | TELELEFVF | 8 |
| 19 | ELELEFVFL | 8 |

TABLE XXXIIII-continued

V5B-HLA-B5101-9mers-98P4B6
Each peptide is a portion of SEQ ID NO: 11; each start position is specified, the length of peptide is 9 amino acids, and the end position for each peptide is the start position plus eight.

| Pos | 123456789 | score |
|---|---|---|
| 23 | EFVFLLTLL | 8 |
| 15 | DTQTELELE | 6 |

TABLE XXXIIII

V6-HLA-B5101-9mers-98P4B6
Each peptide is a portion of SEQ ID NO: 13; each start position is specified, the length of peptide is 9 amino acids, and the end position for each peptide is the start position plus eight.

| Pos | 123456789 | score |
|---|---|---|
| 43 | IPHVSPERV | 23 |
| 2 | LPSIVILGK | 16 |
| 27 | KGWEKSQFL | 16 |
| 35 | LEEGIGGTI | 15 |
| 15 | LPCISRKLK | 14 |
| 17 | CISRKLKRI | 14 |
| 3 | PSIVILGKI | 13 |
| 39 | IGGTIPHVS | 13 |
| 38 | GIGGTIPHV | 12 |
| 4 | SIVILGKII | 11 |
| 7 | ILGKIILFL | 11 |
| 10 | KIILFLPCI | 11 |
| 14 | FLPCISRKL | 11 |
| 45 | HVSPERVTV | 11 |

TABLE XXXIIII

V7A-HLA-B5101-9mers-98P4B6
Each peptide is a portion of SEQ ID NO: 15; each start position is specified, the length of peptide is 9 amino acids, and the end position for each peptide is the start position plus eight.

| Pos | 123456789 | score |
|---|---|---|
| 9 | FLPNGINGI | 14 |
| 1 | SPKSLSETF | 12 |
| 6 | SETFLPNGI | 12 |
| 2 | PKSLSETFL |  |

TABLE XXXIIII

V7B-HLA-B5101-9mers-98P4B6
Each peptide is a portion of SEQ ID NO: 15;
each start position is specified, the
length of peptide is 9 amino acids, and the
end position for each peptide is the start
position plus eight.

| Pos | 123456789 | score |
|---|---|---|
| 4 | MAYQQSTLG | 16 |
| 6 | YQQSTLGYV | 12 |
| 9 | STLGYVALL | 12 |
| 3 | NMAYQQSTL | 9 |
| 8 | QSTLGYVAL | 7 |

TABLE XXXIIII

V7C-HLA-B5101-9mers-98P4B6
Each peptide is a portion of SEQ ID NO: 15;
each start position is specified, the
length of peptide is 9 amino acids, and the
end position for each peptide is the start
position plus eight.

| Pos | 123456789 | score |
|---|---|---|
| 66 | TAEAQESGI | 22 |
| 101 | DPPESPDRA | 20 |
| 112 | AANSWRNPV | 19 |
| 15 | SPAAAWKCL | 18 |
| 160 | LGSGTWMKL | 18 |
| 29 | RGGLSEIVL | 17 |
| 84 | IPVVGVVTE | 17 |
| 102 | PPESPDRAL | 17 |
| 141 | QAASGTLSL | 17 |
| 24 | GANILRGGL | 16 |
| 39 | IEWQQDRKI | 16 |
| 31 | GLSEIVLPI | 15 |
| 68 | EAQESGIRN | 15 |
| 82 | SQIPVVGVV | 15 |
| 108 | RALKAANSW | 15 |
| 149 | LAFTSWSLG | 15 |
| 163 | GTWMKLETI | 15 |
| 5 | ILDLSVEVL | 14 |
| 27 | ILRGGLSEI | 14 |
| 37 | LPIEWQQDR | 14 |
| 47 | IPPLSTPPP | 14 |
| 48 | PPLSTPPPP | 14 |
| 54 | PPPAMWTEE | 14 |

TABLE XXXIIII-continued

V7C-HLA-B5101-9mers-98P4B6
Each peptide is a portion of SEQ ID NO: 15;
each start position is specified, the
length of peptide is 9 amino acids, and the
end position for each peptide is the start
position plus eight.

| Pos | 123456789 | score |
|---|---|---|
| 121 | LPHTNGVGP | 14 |
| 127 | VGPLWEFLL | 14 |
| 128 | GPLWEFLLR | 14 |
| 4 | VILDLSVEV | 13 |
| 13 | LASPAAAWK | 13 |
| 18 | AAWKCLGAN | 13 |
| 52 | TPPPPAMWT | 13 |
| 53 | PPPPAMWTE | 13 |
| 62 | EAGATAEAQ | 13 |
| 95 | EAQDSIDPP | 13 |
| 142 | AASGTLSLA | 13 |
| 164 | TWMKLETII | 13 |
| 17 | AAAWKCLGA | 12 |
| 64 | GATAEAQES | 12 |
| 76 | NKSSSSSQI | 12 |
| 79 | SSSSQIPVV | 12 |
| 92 | EDDEAQDSI | 12 |
| 105 | SPDRALKAA | 12 |
| 111 | KAANSWRNP | 12 |
| 118 | NPVLPHTNG | 12 |
| 129 | PLWEFLLRL | 12 |
| 182 | SKHCMFSLI | 12 |
| 16 | PAAAWKCLG | 11 |
| 28 | LRGGLSEIV | 11 |
| 56 | PAMWTEEAG | 11 |
| 81 | SSQIPVVGV | 11 |
| 119 | PVLPHTNGV | 11 |
| 168 | LETIILSKL | 11 |
| 19 | AWKCLGANI | 10 |
| 23 | LGANILRGG | 10 |
| 30 | GGLSEIVLP | 10 |
| 55 | PPAMWTEEA | 10 |
| 78 | SSSSSQIPV | 10 |
| 113 | ANSWRNPVL | 10 |
| 130 | LWEFLLRLL | 10 |

TABLE XXXIIII

V8-HLA-B5101-9mers-98P4B6
Each peptide is a portion of SEQ ID NO: 17;
each start position is specified, the
length of peptide is 9 amino acids, and the
end position for each peptide is the start
position plus eight.

| Pos | 123456789 | score |
|---|---|---|
| 5 | LEEGMGGTI | 16 |
| 8 | GMGGTIPHV | 12 |
| 9 | MGGTIPHVS | 12 |
| 7 | EGMGGTIPH | 8 |

TABLE XXXIIII

V13-HLA-B5101-9mers-98P4B6
Each peptide is a portion of SEQ ID NO: 27;
each start position is specified, the
length of peptide is 9 amino acids, and the
end position for each peptide is the start
position plus eight.

| Pos | 123456789 | score |
|---|---|---|
| 9 | FLPNGINGI | 14 |
| 1 | SPKSLSETF | 12 |
| 6 | SETFLPNGI | 12 |
| 2 | PKSLSETFL | 8 |

TABLE XXXIIII

V14-HLA-B5101-9mers-98P4B6
Each peptide is a portion of SEQ ID NO: 29;
each start position is specified, the
length of peptide is 9 amino acids, and the
end position for each peptide is the start
position plus eight.

| Pos | 123456789 | score |
|---|---|---|
| 2 | LPLRLFTFW | 16 |
| 8 | TFWRGPVVV | 15 |
| 7 | FTFWRGPVV | 13 |
| 6 | LFTFWRGPV | 10 |
| 9 | FWRGPVVVA | 8 |
| 4 | LRLFTFWRG | 7 |

TABLE XXXIIII

V21-HLA-B5101-9mers-98P4B6
Each peptide is a portion of SEQ ID NO: 43;
each start position is specified, the
length of peptide is 9 amino acids, and the
end position for each peptide is the start
position plus eight.

| Pos | 123456789 | score |
|---|---|---|
| 9 | TKHCMFSLI | 13 |
| 3 | LTQEQKTKH | 7 |
| 8 | KTKHCMFSL | 6 |

TABLE XXXIIII

V25-HLA-B5101-9mers-98P4B6
Each peptide is a portion of SEQ ID NO: 51;
each start position is specified, the
length of peptide is 9 amino acids, and the
end position for each peptide is the start
position plus eight.

| Pos | 123456789 | score |
|---|---|---|
| 4 | LPCISQKLK | 14 |
| 6 | CISQKLKRI | 14 |
| 3 | FLPCISQKL | 10 |
| 9 | QKLKRIKKG | 7 |

TABLE XXXIV

V1-HLA-A1-10mers-98P4B6
Each peptide is a portion of SEQ ID NO: 3;
each start position is specified, the
length of peptide is 10 amino acids, and
the end position for each peptide is the
start position plus nine.

| Pos | 1234567890 | score |
|---|---|---|
| 351 | EEEVWRIEMY | 26 |
| 391 | FSFIQSTLGY | 26 |
| 418 | AFEEEYYRFY | 26 |
| 443 | ILDLLQLCRY | 26 |
| 220 | ISLATFEFLY | 24 |
| 262 | VAITLLSLVY | 23 |
| 327 | RSERYLFLNM | 23 |
| 45 | LTIRLIRCGY | 22 |
| 275 | LLAAAYQLYY | 22 |
| 404 | LISTFHVLIY | 22 |
| 116 | VSNNMRINQY | 20 |
| 123 | NQYPESNAEY | 20 |
| 271 | YLAGLLAAAY | 19 |
| 279 | AYQLYYGTKY | 19 |
| 427 | YTPPNFVLAL | 19 |

TABLE XXXIV-continued

V1-HLA-A1-10mers-98P4B6
Each peptide is a portion of SEQ ID NO: 3; each start position is specified, the length of peptide is 10 amino acids, and the end position for each peptide is the start position plus nine.

| Pos | 1234567890 | score |
|---|---|---|
| 38 | SGDFAKSLTI | 18 |
| 274 | GLLAAAYQLY | 18 |
| 101 | LWDLRHLLVG | 17 |
| 157 | GPKDASRQVY | 17 |
| 178 | VIELARQLNF | 17 |
| 230 | SFVRDVIHPY | 17 |
| 239 | YARNQQSDFY | 17 |
| 396 | STLGYVALLI | 17 |
| 66 | ASEFFPHVVD | 16 |
| 89 | IFVAIHREHY | 16 |
| 94 | HREHYTSLWD | 16 |
| 129 | NAEYLASLFP | 16 |
| 310 | FFFAMVHVAY | 16 |
| 322 | CLPMRRSERY | 16 |
| 329 | ERYLFLNMAY | 16 |
| 350 | NEEEVWRIEM | 15 |
| 414 | GWKRAFEEEY | 15 |
| 415 | WKRAEEEEYY | 15 |
| 13 | LSETCLPNGI | 14 |
| 125 | YPESNAEYLA | 14 |
| 244 | QSDFYKIPIE | 14 |
| 257 | KTLPIVAITL | 14 |
| 76 | VTHHEDALTK | 13 |
| 198 | AREIENLPLR | 13 |
| 366 | MSLGLLSLLA | 13 |
| 420 | EEEYYRFYTP | 13 |
| 25 | IKDARKVTVG | 12 |
| 135 | SLFPDSLIVK | 12 |
| 137 | FPDSLIVKGF | 12 |
| 200 | EIENLPLRLF | 12 |
| 221 | SLATEFFLYS | 12 |
| 251 | PIEIVNKTLP | 12 |
| 268 | SLVYLAGLLA | 12 |

TABLE XXXIV-continued

V1-HLA-A1-10mers-98P4B6
Each peptide is a portion of SEQ ID NO: 3; each start position is specified, the length of peptide is 10 amino acids, and the end position for each peptide is the start position plus nine.

| Pos | 1234567890 | score |
|---|---|---|
| 419 | FEEEYYRFYT | 12 |
| 439 | PSIVILDLLQ | 12 |

TABLE XXXIV

V2-HLA-A1-10mers-98P4B6
Each peptide is a portion of SEQ ID NO: 5; each start position is specified, the length of peptide is 10 amino acids, and the end position for each peptide is the start position plus nine.

| Pos | 1234567890 | score |
|---|---|---|
| 35 | PPCPADFFLY | 24 |
| 22 | CLSLPSSWDY | 16 |
| 28 | SWDYRCPPPC | 12 |
| 2 | GSPGLQALAL | 11 |

TABLE XXXIV

V5A-HLA-A1-10mers-98P4B6
Each peptide is a portion of SEQ ID NO: 11; each start position is specified, the length of peptide is 10 amino acids, and the end position for each peptide is the start position plus nine.

| Pos | 1234567890 | score |
|---|---|---|
| 8 | FTFWRGPVVV | 8 |
| 1 | ENLPLRLFTF | 4 |
| 2 | NLPLRLFTFW | 4 |
| 4 | PLRLFTFWRG | 4 |
| 10 | FWRGPVVVAI | 3 |

TABLE XXXIV

V5B-HLA-A1-10mers-98P4B6
Each peptide is a portion of SEQ ID NO: 11; each start position is specified, the length of peptide is 10 amino acids, and the end position for each peptide is the start position plus nine.

| Pos | 1234567890 | score |
|---|---|---|
| 14 | FADTQTELEL | 17 |
| 18 | QTELELEFVF | 17 |
| 22 | ELEFVFLLTL | 17 |
| 20 | ELELEFVFLL | 14 |

TABLE XXXIV-continued

V5B-HLA-A1-10mers-98P4B6
Each peptide is a portion of SEQ ID NO: 11;
each start position is specified, the
length of peptide is 10 amino acids, and
the end position for each peptide is the
start position plus nine.

| Pos | 1234567890 | score |
|---|---|---|
| 16 | DTQTELELEF | 12 |
| 21 | LELEFVFLLT | 11 |
| 2 | WREFSFIQIF | 10 |
| 5 | FSFIQIFCSF | 8 |
| 24 | EFVFLLTLLL | 8 |

TABLE XXXIV

V6-HLA-A1-10mers-98P4B6
Each peptide is a portion of SEQ ID NO: 13;
each start position is specified, the
length of peptide is 10 amino acids, and
the end position for each peptide is the
start position plus nine.

| Pos | 1234567890 | score |
|---|---|---|
| 29 | GWEKSQFLEE | 19 |
| 35 | FLEEGIGGTI | 13 |
| 36 | LEEGIGGTIP | 12 |
| 1 | LVLPSIVILG | 11 |
| 19 | ISRKLKRIKK | 11 |
| 42 | GTIPHVSPER | 10 |
| 9 | LGKIILFLPC | 9 |

TABLE XXXIV

V7A-HLA-A1-10mers-98P4B6
Each peptide is a portion of SEQ ID NO: 15;
each start position is specified, the
length of peptide is 10 amino acids, and
the end position for each peptide is the
start position plus nine.

| Pos | 1234567890 | score |
|---|---|---|
| 6 | LSETELPNGI | 14 |
| 4 | KSLSETFLPN | 13 |
| 8 | ETFLPNGING | 11 |

TABLE XXXIV

V7B-HLA-A1-10mers-98P4B6
Each peptide is a portion of SEQ ID NO: 15;
each start position is specified, the
length of peptide is 10 amino acids, and
the end position for each peptide is the
start position plus nine.

| Pos | 1234567890 | score |
|---|---|---|
| 5 | MAYQQSTLGY | 21 |
| 10 | STLGYVALLI | 17 |

TABLE XXXIV

V7C-HLA-A1-10mers-98P4B6
Each peptide is a portion of SEQ ID NO: 15;
each start position is specified, the
length of peptide is 10 amino acids, and
the end position for each peptide is the
start position plus nine.

| Pos | 1234567890 | score |
|---|---|---|
| 131 | LWEFLLRLLK | 19 |
| 33 | LSEIVLPIEW | 18 |
| 91 | VTEDDEAQDS | 17 |
| 60 | WTEEAGATAE | 16 |
| 100 | SIDPPESPDR | 16 |
| 70 | AQESGIRNKS | 14 |
| 94 | DDEAQDSIDP | 14 |
| 6 | ILDLSVEVLA | 13 |
| 103 | PPESPDRALK | 13 |
| 124 | HTNGVGPLWE | 13 |
| 168 | KLETIILSKL | 13 |
| 10 | SVEVLASPAA | 12 |
| 39 | PIEWQQDRKI | 12 |
| 43 | QQDRKIPPLS | 12 |
| 52 | STPPPPAMWT | 12 |
| 104 | PESPDRALKA | 12 |
| 106 | SPDRALKAAN | 12 |
| 128 | VGPLWEFLLR | 12 |
| 170 | ETIILSKLTQ | 12 |
| 97 | AQDSIDPPES | 11 |
| 115 | NSWRNPVLPH | 11 |
| 154 | SWSLGEFLGS | 11 |
| 2 | PSIVILDLSV | 10 |
| 61 | TEEAGATAEA | 10 |
| 67 | TAEAQESGIR | 10 |
| 92 | TEDDEAQDSI | 10 |

TABLE XXXIV-continued

V7C-HLA-A1-10mers-98P4B6
Each peptide is a portion of SEQ ID NO: 15;
each start position is specified, the
length of peptide is 10 amino acids, and
the end position for each peptide is the
start position plus nine.

| Pos | 1234567890 | score |
|---|---|---|
| 93 | EDDEAQDSID | 10 |
| 157 | LGEFLGSGTW | 10 |
| 162 | GSGTWMKLET | 10 |
| 178 | TQEQKSKHCM | 10 |
| 51 | LSTPPPPAMW | 9 |
| 146 | GTLSLAFTSW | 9 |
| 182 | KSKHCMFSLI | 9 |

TABLE XXXIV

V8-HLA-A1-10mers-98P4B6
Each peptide is a portion of SEQ ID NO: 17;
each start position is specified, the
length of peptide is 10 amino acids, and
the end position for each peptide is the
start position plus nine.

| Pos | 1234567890 | score |
|---|---|---|
| 5 | FLEEGMGGTI | 13 |
| 6 | LEEGMGGTIP | 12 |

TABLE XXXIV

V13-HLA-A1-10mers-98P4B6
Each peptide is a portion of SEQ ID NO: 27;
each start position is specified, the
length of peptide is 10 amino acids, and
the end position for each peptide is the
start position plus nine.

| Pos | 1234567890 | score |
|---|---|---|
| 6 | LSETFLPNGI | 14 |
| 4 | KSLSETFLPN | 13 |
| 8 | ETFLPNGING | 11 |

TABLE XXXIV

V7C-HLA-A1-10mers-98P4B6
Each peptide is a portion of SEQ ID NO: 29;
each start position is specified, the
length of peptide is 10 amino acids, and
the end position for each peptide is the
start position plus nine.

| Pos | 1234567890 | score |
|---|---|---|
| 8 | FTFWRGPVVV | 8 |
| 1 | ENLPLRLFTF | 4 |
| 2 | NLPLRLFTFW | 4 |

TABLE XXXIV-continued

V7C-HLA-A1-10mers-98P4B6
Each peptide is a portion of SEQ ID NO: 29;
each start position is specified, the
length of peptide is 10 amino acids, and
the end position for each peptide is the
start position plus nine.

| Pos | 1234567890 | score |
|---|---|---|
| 4 | PLRLFTFWRG | 4 |
| 10 | FWRGPVVVAI | 3 |

TABLE XXXIV

V21-HLA-A1-10mers-98P4B6
Each peptide is a portion of SEQ ID NO: 43;
each start position is specified, the
length of peptide is 10 amino acids, and
the end position for each peptide is the
start position plus nine.

| Pos | 1234567890 | score |
|---|---|---|
| 9 | KTKHCMIFSLI | 11 |
| 5 | TQEQKTKHCM | 10 |
| 1 | LSKLTQEQKT | 6 |
| 4 | LTQEQKTKHC | 6 |
| 10 | TKHCMFSLIS | 6 |

TABLE XXXIV

V25-HLA-A1-10mers-98P4B6
Each peptide is a portion of SEQ ID NO: 51;
each start position is specified, the
length of peptide is 10 amino acids, and
the end position for each peptide is the
start position plus nine.

| Pos | 1234567890 | score |
|---|---|---|
| 8 | ISQKLKRIKK | 11 |
| 5 | LPCISQKLKR | 8 |
| 3 | LFLPCISQKL | 6 |

TABLE XXXV

V1-HLA-A0201-10mers-98P4B6
Each peptide is a portion of SEQ ID NO: 3;
each start position is specified, the
length of peptide is 10 amino acids, and
the end position for each peptide is the
start position plus nine.

| Pos | 1234567890 | score |
|---|---|---|
| 373 | LLAVTSIPSV | 31 |
| 266 | LLSLVYLAGL | 29 |
| 107 | LLVGKILIDV | 28 |
| 367 | SLGLLSLLAV | 28 |
| 435 | ALVLPSIVIL | 28 |

TABLE XXXV-continued

V1-HLA-A0201-10mers-98P4B6
Each peptide is a portion of SEQ ID NO: 3;
each start position is specified, the
length of peptide is 10 amino acids, and
the end position for each peptide is the
start position plus nine.

| Pos | 1234567890 | score |
|-----|------------|-------|
| 364 | GIMSLGLLSL | 27 |
| 132 | YLASLFPDSL | 26 |
| 370 | LLSLLAVTSI | 26 |
| 437 | VLPSIVILDL | 26 |
| 82  | ALTKTNIIFV | 25 |
| 100 | SLWDLRHLLV | 25 |
| 140 | SLIVKGFNVV | 25 |
| 263 | AITLLSLVYL | 25 |
| 306 | GLLSFFFAMV | 25 |
| 402 | ALLISTFHVL | 25 |
| 440 | SIVILDLLQL | 25 |
| 258 | TLPIVAITLL | 24 |
| 365 | IMSLGLLSLL | 24 |
| 403 | LLISTFHVLI | 24 |
| 427 | YTPPNFVLAL | 24 |
| 24  | GIKDARKVTV | 23 |
| 48  | RLIRCGYHVV | 23 |
| 103 | DLRHLLVGKI | 23 |
| 433 | VLALVLPSIV | 23 |
| 92  | AIHREHYTSL | 22 |
| 260 | PIVAITLLSL | 22 |
| 261 | IVAITLLSLV | 22 |
| 298 | WLQCRKQLGL | 22 |
| 432 | FVLALVLPSI | 22 |
| 207 | RLFTLWRGPV | 21 |
| 210 | TLWRGPVVVA | 21 |
| 257 | KTLPIVAITL | 21 |
| 385 | ALNWREFSFI | 21 |
| 49  | LIRCGYHVVI | 20 |
| 98  | YTSLWDLRHL | 20 |
| 172 | IQARQQVIEL | 20 |
| 186 | NFIPIDLGSL | 20 |
| 219 | AISLATFFFL | 20 |
| 227 | FLYSFVRDVI | 20 |
| 249 | KIPIEIVNKT | 20 |

TABLE XXXV-continued

V1-HLA-A0201-10mers-98P4B6
Each peptide is a portion of SEQ ID NO: 3;
each start position is specified, the
length of peptide is 10 amino acids, and
the end position for each peptide is the
start position plus nine.

| Pos | 1234567890 | score |
|-----|------------|-------|
| 253 | EIVNKTLPIV | 20 |
| 12  | SLSETCLPNG | 19 |
| 135 | SLFPDSLIVK | 19 |
| 142 | IVKGFNVVSA | 19 |
| 197 | SAREIENLPL | 19 |
| 209 | FTLWRGPVVV | 19 |
| 211 | LWRGPVVVAI | 19 |
| 271 | YLAGLLAAAY | 19 |
| 312 | FAMVHVAYSL | 19 |
| 396 | STLGYVALLI | 19 |
| 16  | TCLPNGINGI | 18 |
| 65  | FASEFFPHVV | 18 |
| 67  | SEFFPHVVDV | 18 |
| 113 | LIDVSNNMRI | 18 |
| 359 | MYISFGIMSL | 18 |
| 392 | SFIQSTLGYV | 18 |
| 106 | HLLVGKILID | 17 |
| 179 | IELARQLNFI | 17 |
| 202 | ENLPLRLFTL | 17 |
| 250 | IPIEIVNKTL | 17 |
| 264 | ITLLSLVYLA | 17 |
| 269 | LVYLAGLLAA | 17 |
| 348 | SWNEEEVWRI | 17 |
| 361 | ISFGIMSLGL | 17 |
| 369 | GLLSLLAVTS | 17 |
| 401 | VALLISTFHV | 17 |
| 26  | KDARKVTVGV | 16 |
| 41  | FAKSLTIRLI | 16 |
| 111 | KILIDVSNNM | 16 |
| 112 | ILIDVSNNMR | 16 |
| 127 | ESNAEYLASL | 16 |
| 195 | LSSAREIENL | 16 |
| 223 | ATFFFLYSFV | 16 |
| 226 | FFLYSFVRDV | 16 |
| 268 | SLVYLAGLLA | 16 |

TABLE XXXV-continued

V1-HLA-A0201-10mers-98P4B6
Each peptide is a portion of SEQ ID NO: 3;
each start position is specified, the
length of peptide is 10 amino acids, and
the end position for each peptide is the
start position plus nine.

| Pos | 1234567890 | score |
|---|---|---|
| 299 | LQGRKQLGLL | 16 |
| 356 | RIEMYISFGI | 16 |
| 362 | SFGIMSLGLL | 16 |
| 377 | TSIPSVSNAL | 16 |
| 428 | TPPNIFVLALV | 16 |
| 434 | LALVLPSIVI | 16 |
| 438 | LPSIVILDLL | 16 |
| 443 | ILDLLQLCRY | 16 |
| 27 | DARKVTVGVI | 15 |
| 36 | IGSGDFAKSL | 15 |
| 44 | SLTIRLIRCG | 15 |
| 47 | IRLIRCGYHV | 15 |
| 147 | NVVSAWALQL | 15 |
| 166 | YICSNNIQAR | 15 |
| 189 | PIDLGSLSSA | 15 |
| 199 | REIENLPLRL | 15 |
| 221 | SLATFFFLYS | 15 |
| 255 | VNKTLPIVAI | 15 |
| 273 | AGLLAAAYQL | 15 |
| 275 | LLAAAYQLYY | 15 |
| 314 | MVHVAYSLCL | 15 |
| 335 | NMAYQQVHAN | 15 |
| 336 | MAYQQVHANI | 15 |
| 345 | IENSWNEEEV | 15 |
| 394 | IQSTLGYVAL | 15 |
| 395 | QSTLGYVALL | 15 |
| 404 | LISTFHVLIY | 15 |
| 411 | LIYGWKRAFE | 15 |

TABLE XXXV

V2-HLA-A0201-10mers-98P4B6
Each peptide is a portion of SEQ ID NO: 5;
each start position is specified, the
length of peptide is 10 amino acids, and
the end position for each peptide is the
start position plus nine.

| Pos | 1234567890 | score |
|---|---|---|
| 2 | GSPGLQALSL | 16 |
| 5 | GLQALSLSLS | 15 |
| 16 | GFTPFSCLSL | 15 |
| 10 | SLSLSSGFTP | 14 |
| 8 | ALSLSLSSGF | 13 |
| 12 | SLSSGFTPFS | 13 |
| 24 | SLPSSWDYRC | 13 |
| 4 | PGLQALSLSL | 12 |
| 7 | QALSLSLSSG | 12 |
| 14 | SSGFTPFSCL | 11 |
| 22 | CLSLPSSWDY | 10 |
| 9 | LSLSLSSGFT | 8 |
| 17 | FTPFSCLSLP | 8 |
| 6 | LQALSLSLSS | 7 |
| 34 | PPPCPADFFL | 7 |

TABLE XXXV

V5A-HLA-A0201-10mers-98P4B6
Each peptide is a portion of SEQ ID NO: 11;
each start position is specified, the
length of peptide is 10 amino acids, and
the end position for each peptide is the
start position plus nine.

| Pos | 1234567890 | score |
|---|---|---|
| 6 | RLFTFWRGPV | 21 |
| 8 | FTFWRGPVVV | 18 |
| 10 | FWRGPVVVAI | 18 |
| 7 | LFTFWRGPVV | 11 |
| 9 | TFWRGPVVVA | 11 |
| 2 | NLPLRLFTFW | 10 |

TABLE XXXV

V5B-HLA-A0201-10mers-98P4B6
Each peptide is a portion of SEQ ID NO: 11;
each start position is specified, the
length of peptide is 10 amino acids, and
the end position for each peptide is the
start position plus nine.

| Pos | 1234567890 | score |
|---|---|---|
| 22 | ELEFVFLLTL | 22 |
| 20 | ELELEFVFLL | 20 |

TABLE XXXV-continued

V5B-HLA-A0201-10mers-98P4B6
Each peptide is a portion of SEQ ID NO: 11; each start position is specified, the length of peptide is 10 amino acids, and the end position for each peptide is the start position plus nine.

| Pos | 1234567890 | score |
|---|---|---|
| 14 | FADTQTELEL | 18 |
| 23 | LEFVFLLTLL | 17 |
| 19 | TELELEFVFL | 16 |
| 17 | TQTELELEFV | 15 |
| 12 | CSFADTQTEL | 13 |
| 9 | QIFCSFADTQ | 11 |
| 21 | LELEFVFLLT | 11 |
| 1 | NWREFSFIQI | 10 |
| 7 | FIQIFCSFAD | 10 |

TABLE XXXV

V6-HLA-A0201-10mers-98P4B6
Each peptide is a portion of SEQ ID NO: 13; each start position is specified, the length of peptide is 10 amino acids, and the end position for each peptide is the start position plus nine.

| Pos | 1234567890 | score |
|---|---|---|
| 7 | VILGKIILFL | 28 |
| 35 | FLEEGIGGTI | 22 |
| 5 | SIVILGKIIL | 20 |
| 14 | LFLPCISRKL | 18 |
| 43 | TIPHVSPERV | 18 |
| 2 | VLPSIVILGK | 17 |
| 13 | ILFLPCISRK | 17 |
| 3 | LPSIVILGKI | 16 |
| 8 | ILGKIILFLP | 16 |
| 10 | GKIILFLPCI | 16 |
| 38 | EGIGGTIPHV | 16 |
| 1 | LVLPSIVILG | 14 |
| 46 | HVSPERVTVM | 14 |
| 12 | IILFLPCISR | 13 |
| 34 | QFLEEGIGGT | 13 |

TABLE XXXV

V7A-HLA-A0201-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 5 | SLSETFLPNG | 19 |
| 9 | TFLPNGINGI | 18 |
| 2 | SPKSLSETFL | 11 |
| 6 | LSETFLPNGI | 11 |
| 10 | FLPNGINGIK | 11 |

TABLE XXXV

V7B-HLA-A0201-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 10 | STLGYVALLI | 19 |
| 2 | FLNMAYQQST | 18 |
| 6 | AYQQSTLGYV | 16 |
| 3 | LNMAYQQSTL | 15 |
| 9 | QSTLGYVALL | 15 |
| 8 | QQSTLGYVAL | 13 |
| 4 | NMAYQQSTLG | 9 |

TABLE XXXV

V7C-HLA-A0201-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 5 | VILDLSVEVL | 26 |
| 168 | KLETIILSKL | 26 |
| 27 | NILRGGLSEI | 24 |
| 28 | ILRGGLSEIV | 24 |
| 130 | PLWEFLLRLL | 24 |
| 160 | FLGSGTWMKL | 23 |
| 4 | IVILDLSVEV | 22 |
| 66 | ATAEAQESGI | 19 |
| 81 | SSSQIPVVGV | 19 |
| 156 | SLGEFLGSGT | 19 |

TABLE XXXV-continued

V7C-HLA-A0201-10mers-98P4B6
Each peptide is a portion of SEQ ID NO: 15;
each start position is specified, the
length of peptide is 10 amino acids, and
the end position for each peptide is the
start position plus nine.

| Pos | 1234567890 | score |
|---|---|---|
| 6 | ILDLSVEVLA | 18 |
| 32 | GLSEIVLPIE | 18 |
| 112 | KAANSWRNPV | 18 |
| 113 | AANSWRNPVL | 18 |
| 129 | GPLWEFLLRL | 18 |
| 8 | DLSVEVLASP | 17 |
| 19 | AAWKCLGANI | 17 |
| 79 | SSSSSQIPVV | 17 |
| 127 | GVGPLWEFLL | 17 |
| 134 | FLLRLLKSQA | 17 |
| 135 | LLRLLKSQAA | 17 |
| 141 | SQAASGTLSL | 17 |
| 31 | GGLSEIVLPI | 16 |
| 42 | WQQDRKIPPL | 16 |
| 58 | AMWTEEAGAT | 16 |
| 82 | SSQIPVVGVV | 16 |
| 84 | QIPVVGVVTE | 16 |
| 122 | LPHTNGVGPL | 16 |
| 137 | RLLKSQAASG | 16 |
| 138 | LLKSQAASGT | 16 |
| 148 | LSLAFTSWSL | 16 |
| 13 | VLASPAAAWK | 15 |
| 23 | CLGANILRGG | 15 |
| 24 | LGANILRGGL | 15 |
| 152 | FTSWSLGEFL | 15 |
| 163 | SGTWMKLETI | 15 |
| 3 | SIVILDLSVE | 14 |
| 29 | LRGGLSEIVL | 14 |
| 39 | PIEWQQDRKI | 14 |
| 121 | VLPHTNGVGP | 14 |
| 139 | LKSQAASGTL | 14 |
| 142 | QAASGTLSLA | 14 |
| 164 | GTWMKLETII | 14 |
| 171 | TIILSKLTQE | 14 |
| 172 | IILSKLTQEQ | 14 |

TABLE XXXV-continued

V7C-HLA-A0201-10mers-98P4B6
Each peptide is a portion of SEQ ID NO: 15;
each start position is specified, the
length of peptide is 10 amino acids, and
the end position for each peptide is the
start position plus nine.

| Pos | 1234567890 | score |
|---|---|---|
| 18 | AAAWKCLGAN | 13 |
| 50 | PLSTPPPPAM | 13 |
| 100 | SIDPPESPDR | 13 |
| 149 | SLAFTSWSLG | 13 |
| 2 | PSIVILDLSV | 12 |
| 20 | AWKCLGANIL | 12 |
| 47 | KIPPLSTPPP | 12 |
| 52 | STPPPPAMWT | 12 |
| 83 | SQIPVVGVVT | 12 |
| 102 | DPPESPDRAL | 12 |
| 119 | NPVLPHTNGV | 12 |
| 126 | NGVGPLWEFL | 12 |
| 144 | ASGTLSLAFT | 12 |
| 173 | ILSKLTQEQK | 12 |
| 176 | KLTQEQKSKH | 12 |
| 181 | QKSKHCMFSL | 12 |

TABLE XXXV

V8C-HLA-A0201-10mers-98P4B6
Each peptide is a portion of SEQ ID NO: 17;
each start position is specified, the
length of peptide is 10 amino acids, and
the end position for each peptide is the
start position plus nine.

| Pos | 1234567890 | score |
|---|---|---|
| 5 | FLEEGMGGTI | 22 |
| 8 | EGMFFTIPHV | 15 |
| 9 | GMGGTIPHVS | 12 |

TABLE XXXV

V13-HLA-A0201-10mers-98P4B6
Each peptide is a portion of SEQ ID NO: 27;
each start position is specified, the
length of peptide is 10 amino acids, and
the end position for each peptide is the
start position plus nine.

| Pos | 1234567890 | score |
|---|---|---|
| 5 | SLSETFLPNG | 19 |
| 9 | TFLPNGINGI | 18 |

TABLE XXXV-continued

V13-HLA-A0201-10mers-98P4B6
Each peptide is a portion of SEQ ID NO: 27;
each start position is specified, the
length of peptide is 10 amino acids, and
the end position for each peptide is the
start position plus nine.

| Pos | 1234567890 | score |
|---|---|---|
| 2 | SPKSLSETFL | 11 |
| 6 | LSETFLPNGI | 11 |
| 10 | FLPNGINGIK | 11 |

TABLE XXXV

V14-HLA-A0201-10mers-98P4B6
Each peptide is a portion of SEQ ID NO: 29; each
start position is specified, the length of peptide
is 10 amino acids, and the end position for each
peptide is the start position plus nine.

| Pos | 1234567890 | score |
|---|---|---|
| 6 | RLFTFWRGPV | 21 |
| 8 | FTFWRGPVVV | 18 |
| 10 | FWRGPVVVAI | 18 |
| 7 | LFTFWRGPVV | 11 |
| 9 | TFWRGPVVVA | 11 |
| 2 | NLPLRLFTFW | 10 |

TABLE XXXV

V21-HLA-A0201-10mers-98P4B6
Each peptide is a portion of SEQ ID NO: 43; each
start position is specified, the length of peptide
is 10 amino acids, and the end position for each
peptide is the start position plus nine.

| Pos | 1234567890 | score |
|---|---|---|
| 3 | KLTQEQKTKH | 12 |
| 9 | KTKHCMFSLI | 12 |
| 8 | QKTKHCMFSL | 11 |
| 1 | LSKLTQEQKT | 7 |
| 4 | LTQEQKTKHC | 7 |
| 2 | SKLTQEQKTK | 5 |

TABLE XXXV

V25-HLA-A0201-10mers-98P4B6
Each peptide is a portion of SEQ ID NO: 51;
each start position is specified, the length of peptide
is 10 amino acids, and the end position for each
peptide is the start position plus nine.

| Pos | 1234567890 | score |
|---|---|---|
| 3 | LFLPCISQKL | 18 |
| 2 | ILFLPCISQK | 17 |

TABLE XXXV-continued

V25-HLA-A0201-10mers-98P4B6
Each peptide is a portion of SEQ ID NO: 51; each
start position is specified, the length of peptide
is 10 amino acids, and the end position for each
peptide is the start position plus nine.

| Pos | 1234567890 | score |
|---|---|---|
| 1 | IILFLPCISQ | 13 |
| 4 | FLPCISQKLK | 10 |
| 6 | PCISQKLKRI | 10 |
| 7 | CISQKLKRIK | 8 |

TABLE XXXVI

V1-HLA-A0203-10mers-98P4B6
Each peptide is a portion of SEQ ID NO: 3; each
start position is specified, the length of peptide
is 10 amino acids, and the end position for each
peptide is the start position plus nine.

| Pos | 1234567890 | score |
|---|---|---|
| 270 | VYLAGLLAAA | 27 |
| 269 | LVYLAGLLAA | 19 |
| 144 | KGFNVVSAWA | 18 |
| 271 | YLAGLLAAAY | 17 |

TABLE XXXVI

V2-HLA-A0203-10mers-98P4B6
Each peptide is a portion of SEQ ID NO: 5; each
start position is specified, the length of peptide
is 10 amino acids, and the end position for each
peptide is the start position plus nine.

| Pos | 1234567890 | score |
|---|---|---|
| 30 | DYRCPPPCPA | 10 |
| 31 | YRCPPPCPAD | 9 |
| 1 | SGSPGLQALS | 8 |
| 32 | RCPPPCPADF | 8 |

TABLE XXXVI

V5A-HLA-A0203-10mers-98P4B6
Each peptide is a portion of SEQ ID NO: 11; each
start position is specified, the length of peptide
is 10 amino acids, and the end position for each
peptide is the start position plus nine.

| Pos | 1234567890 | score |
|---|---|---|
| 9 | TFWRGPVVVA | 10 |
| 10 | FWRGPVVVAI | 9 |

TABLE XXXVI

V5B-HLA-A0203-10mers-98P4B6
Each peptide is a portion of SEQ ID NO: 11; each start position is specified, the length of peptide is 10 amino acids, and the end position for each peptide is the start position plus nine.

| Pos | 1234567890 | score |
|---|---|---|
| 6 | SFIQIFCSFA | 10 |
| 7 | FIQIFCSFAD | 9 |
| 8 | IQIFCSFADT | 8 |

TABLE XXXVI

V6-HLA-A0203-10mers-98P4B6

| Pos | 1234567890 | score |
|---|---|---|
| NoResultsFound. | | |

TABLE XXXVI

V7A-HLA-A0203-10mers-98P4B6

| Pos | 1234567890 | score |
|---|---|---|
| NoResultsFound. | | |

TABLE XXXVI

V7B-HLA-A0203-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 7 | YQQSTLGYVA | 10 |
| 8 | QQSTLGYVAL | 9 |
| 9 | QSTLGYVALL | 8 |

TABLE XXXVI

V7C-HLA-A0203-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 11 | VEVLASPAAA | 27 |
| 10 | SVEVLASPAA | 19 |
| 105 | ESPDRALKAA | 19 |
| 135 | LLRLLKSQAA | 19 |
| 57 | PAMWTEEAGA | 18 |
| 59 | MWTEEAGATA | 18 |
| 61 | TEEAGATAEA | 18 |
| 12 | EVLASPAAAW | 17 |
| 106 | SPDRALKAAN | 17 |
| 136 | LRLLKSQAAS | 17 |

TABLE XXXVI

V8-HLA-A0203-10mers-98P4B6

| Pos | 1234567890 | score |
|---|---|---|
| NoResultsFound. | | |

TABLE XXXVI

V13-HLA-A0203-10mers-98P4B6

| Pos | 1234567890 | score |
|---|---|---|
| NoResultsFound. | | |

TABLE XXXVI

V14-HLA-A0203-10mers-98P4B6
Each peptide is a portion of SEQ ID NO: 29; each start position is specified, the length of peptide is 10 amino acids, ad the end position for each peptide is the start position plus nine.

| Pos | 1234567890 | score |
|---|---|---|
| 9 | TFWRGPVVVA | 10 |
| 10 | FWRGPVVVAI | 9 |

TABLE XXXVI

V21-HLA-A0203-10mers-98P4B6

| Pos | 1234567890 | score |
|---|---|---|
| NoResultsFound. | | |

TABLE XXXVI

V25-HLA-A0203-10mers-98P4B6

| Pos | 1234567890 | score |
|---|---|---|
| NoResultsFound. | | |

TABLE XXXVII

V1-HLA-A3-10mers-98P4B6
Each peptide is a portion of SEQ ID NO: 3; each start position is specified, the length of peptide is 10 amino acids, and the end position for each peptide is the start position plus nine.

| Pos | 1234567890 | score |
|---|---|---|
| 135 | SLFPDSLIVK | 28 |
| 34 | GVIGSGDFAK | 26 |
| 271 | YLAGLLAAAY | 26 |
| 48 | RLIRCGYHVV | 24 |
| 21 | GINGIKDARK | 23 |
| 216 | VVVAISLATF | 23 |
| 369 | GLLSLLAVTS | 23 |
| 17 | CLPNGINGIK | 22 |
| 55 | HVVIGSRNPK | 22 |
| 275 | LLAAAYQLYY | 22 |
| 278 | AAYQLYYGTK | 22 |
| 307 | LLSFFFAMVH | 22 |
| 112 | ILIDVSNNMR | 21 |
| 142 | IVKGFNVVSA | 21 |
| 155 | QLGPKDASRQ | 21 |
| 210 | TLWRGPVVVA | 21 |
| 76 | VTHHEDALTK | 20 |
| 217 | VVAISLATFF | 20 |
| 248 | YKIPIEIVNK | 20 |
| 274 | GLLAAAYQLY | 20 |
| 281 | QLYYGTKYRR | 20 |
| 294 | WLETWLQCRK | 20 |
| 402 | ALLISTFHVL | 20 |
| 2 | ESISMMGSPK | 19 |
| 49 | LIRCGYHVVI | 19 |
| 56 | VVIGSRNPKF | 19 |
| 102 | WDLRHLLVGK | 19 |
| 147 | NVVSAWALQL | 19 |
| 227 | FLYSFVRDVI | 19 |
| 269 | LVYLAGLLAA | 19 |
| 375 | AVTSIPSVSN | 19 |
| 443 | ILDLLQLCRY | 19 |
| 24 | GIKDARKVTV | 18 |
| 140 | SLIVKGFNVV | 18 |
| 333 | FLNMAYQQVH | 18 |
| 410 | VLIYGWKRAF | 18 |
| 411 | LIYGWKRAFE | 18 |
| 435 | ALVLPSIVIL | 18 |
| 442 | VILDLLQLCR | 18 |
| 46 | TIRLIRCGYH | 17 |
| 92 | AIHREHYTSL | 17 |
| 164 | QVYICSNNIQ | 17 |
| 177 | QVIELARQLN | 17 |
| 254 | IVNKTLPIVA | 17 |
| 261 | IVAITLLSLV | 17 |
| 268 | SLVYLAGLLA | 17 |
| 331 | YLFLNMAYQQ | 17 |
| 400 | YVALLISTFH | 17 |
| 403 | LLISTFHVLI | 17 |
| 404 | LISTFHVLIY | 17 |
| 30 | KVTVGVIGSG | 16 |
| 123 | NQYPESNAEY | 16 |
| 141 | LIVKGFNVVS | 16 |
| 178 | VIELARQLNF | 16 |
| 207 | RLFTLWRGPV | 16 |
| 234 | DVIHPYARNQ | 16 |
| 262 | VAITLLSLVY | 16 |
| 263 | AITLLSLVYL | 16 |
| 265 | TLLSLVYLAG | 16 |
| 306 | GLLSFFFAMV | 16 |
| 322 | CLPMRRSERY | 16 |
| 340 | QVHANIENSW | 16 |
| 367 | SLGLLSLLAV | 16 |
| 385 | ALNWREFSFI | 16 |
| 432 | FVLALVLPSI | 16 |
| 433 | VLALVLPSIV | 16 |
| 440 | SIVILDLLQL | 16 |
| 441 | IVILDLLQLC | 16 |
| 32 | TVGVIGSGDF | 15 |
| 100 | SLWDLRHLLV | 15 |
| 106 | HLLVGKILID | 15 |

TABLE XXXVII-continued

V1-HLA-A3-10mers-98P4B6
Each peptide is a portion of SEQ ID NO: 3; each start position is specified, the length of peptide is 10 amino acids, and the end position for each peptide is the start position plus nine.

| Pos | 1234567890 | score |
|---|---|---|
| 121 | RINQYPESNA | 15 |
| 153 | ALQLGPKDAS | 15 |
| 187 | FIPIDLGSLS | 15 |
| 221 | SLATFFFLYS | 15 |
| 235 | VIHPYARNQQ | 15 |
| 257 | KTLPIVAITL | 15 |
| 260 | PIVAITLLSL | 15 |
| 320 | SLCLPMRRSE | 15 |
| 372 | SLLAVTSIPS | 15 |
| 393 | FIQSTLGYVA | 15 |
| 436 | LVLPSIVILD | 15 |
| 60 | SRNPKFASEF | 14 |
| 88 | IIFVAIHREH | 14 |
| 103 | DLRHLLVGKI | 14 |
| 108 | LVGKILIDVS | 14 |
| 111 | KILIDVSNNM | 14 |
| 132 | YLASLFPDSL | 14 |
| 150 | SAWALQLGPK | 14 |
| 171 | NIQARQQVIE | 14 |
| 180 | ELARQLNFIP | 14 |
| 189 | PIDLGSLSSA | 14 |
| 190 | IDLGSLSSAR | 14 |
| 205 | PLRLFTLWRG | 14 |
| 215 | PVVVAISLAT | 14 |
| 231 | FVRDVIHPYA | 14 |
| 266 | LLSLVYLAGL | 14 |
| 279 | AYQLYYGTKY | 14 |
| 316 | HVAYSLCLPM | 14 |
| 370 | LLSLLAVTSI | 14 |
| 45 | LTIRLIRCGY | 13 |
| 75 | DVTHHEDALT | 13 |
| 82 | ALTKTNIIFV | 13 |
| 128 | SNAEYLASLF | 13 |
| 154 | LQLGPKDASR | 13 |
| 157 | GPKDASRQVY | 13 |
| 166 | YICSNNIQAR | 13 |

TABLE XXXVII-continued

V1-HLA-A3-10mers-98P4B6
Each peptide is a portion of SEQ ID NO: 3; each start position is specified, the length of peptide is 10 amino acids, and the end position for each peptide is the start position plus nine.

| Pos | 1234567890 | score |
|---|---|---|
| 191 | DLGSLSSARE | 13 |
| 200 | EIENLPLRLF | 13 |
| 204 | LPLRLFTLWR | 13 |
| 240 | ARNQQSDFYK | 13 |
| 298 | WLQCRKQLGL | 13 |
| 304 | QLGLLSFFFA | 13 |
| 310 | FFFAMVHVAY | 13 |
| 314 | MVHVAYSLCL | 13 |
| 321 | LCLPMRRSER | 13 |
| 329 | ERYLFLNMAY | 13 |
| 353 | EVWRIEMYIS | 13 |
| 364 | GIMSLGLLSL | 13 |
| 373 | LLAVTSIPSV | 13 |
| 397 | TLGYVALLIS | 13 |
| 399 | GYVALLISTF | 13 |
| 409 | HVLIYGWKRA | 13 |
| 437 | VLPSIVILDL | 13 |
| 445 | DLLQLCRYPD | 13 |

TABLE XXXVII

V2-HLA-A3-10mers-98P4B6
Each peptide is a portion of SEQ ID NO: 5; each start position is specified, the length of peptide is 10 amino acids, and the end position for each peptide is the start position plus nine.

| Pos | 1234567890 | score |
|---|---|---|
| 8 | ALSLSLSSGF | 21 |
| 10 | SLSLSSGFTP | 19 |
| 22 | CLSLPSSWDY | 17 |
| 5 | GLQALSLSLS | 15 |
| 32 | RCPPPCPADF | 15 |
| 12 | SLSSGFTPFS | 11 |
| 24 | SLPSSWDYRC | 11 |
| 2 | GSPGLQALSL | 10 |
| 33 | CPPPCPADFF | 10 |

TABLE XXXVII

V5A-HLA-A3-10mers-98P4B6
Each peptide is a portion of SEQ ID NO: 11; each start position is specified, the length of peptide is 10 amino acids, and the end position for each peptide is the start position plus nine.

| Pos | 1234567890 | score |
|---|---|---|
| 6 | RLFTFWRGPV | 16 |
| 4 | PLRLFTFWRG | 14 |
| 1 | ENLPLRLFTF | 13 |
| 2 | NLPLRLFTFW | 12 |
| 9 | TFWRGPVVVA | 11 |
| 3 | LPLRLFTFWR | 10 |
| 10 | FWRGPVVVAI | 10 |
| 8 | FTFWRGPVVV | 9 |
| 7 | LFTFWRGPVV | 7 |

TABLE XXXVII

V5B-HLA-A3-10mers-98P4B6
Each peptide is a portion of SEQ ID NO: 11; each start position is specified, the length of peptide is 10 amino acids, and the end position for each peptide is the start position plus nine.

| Pos | 1234567890 | score |
|---|---|---|
| 9 | QIFCSEADTQ | 17 |
| 22 | ELEFVFLLTL | 17 |
| 18 | QTELELEFVF | 11 |
| 20 | ELELEFVFLL | 11 |
| 7 | FIQIFCSFAD | 10 |
| 8 | IQIFCSFADT | 8 |

TABLE XXXVII

V6-HLA-A3-10mers-98P4B6
Each peptide is a portion of SEQ ID NO: 13; each start position is specified, the length of peptide is 10 amino acids, and the end position for each peptide is the start position plus nine.

| Pos | 1234567890 | score |
|---|---|---|
| 13 | ILFLPCISRK | 26 |
| 2 | VLPSIVILGK | 23 |
| 15 | FLPCISRKLK | 21 |
| 18 | CISRKLKRIK | 21 |
| 6 | IVILGKIILF | 20 |
| 22 | KLKRIKKGWE | 19 |
| 35 | FLEEGIGGTI | 19 |
| 12 | IILFLPCISR | 18 |

TABLE XXXVII-continued

V6-HLA-A3-10mers-98P4B6
Each peptide is a portion of SEQ ID NO: 13; each start position is specified, the length of peptide is 10 amino acids, and the end position for each peptide is the start position plus nine.

| Pos | 1234567890 | score |
|---|---|---|
| 46 | HVSPERVTVM | 18 |
| 23 | LKRIKKGWEK | 17 |
| 11 | KIILFLPCIS | 16 |
| 19 | ISRKLKRIKK | 16 |
| 1 | LVLPSIVILG | 15 |
| 7 | VILGKIILFL | 15 |
| 25 | RIKKGWEKSQ | 15 |
| 26 | IKKGWEKSQF | 15 |
| 39 | GIGGTIPHVS | 15 |
| 8 | ILGKIILFLP | 12 |

TABLE XXXVII

V7A-HLA-A3-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 10 | FLPNGINGIK | 22 |
| 5 | SLSETFLPNG | 12 |

TABLE XXXVII

V7B-HLA-A3-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 5 | MAYQQSTLGY | 13 |
| 2 | FLNMAYQQST | 12 |
| 10 | STLGYVALLI | 11 |
| 3 | LNMAYQQSTL | 9 |
| 7 | YQQSTLGYVA | 7 |
| 8 | QQSTLGYVAL | 7 |
| 1 | LFLNMAYQQS | 6 |
| 9 | QSTLGYVALL | 6 |

TABLE XXXVII

V7C-HLA-A3-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 13 | VLASPAAAWK | 28 |
| 173 | ILSKLTQEQK | 25 |
| 137 | RLLKSQAASG | 24 |
| 12 | EVLASPAAAW | 21 |
| 134 | FLLRLLKSQA | 21 |
| 4 | IVILDLSVEV | 20 |
| 36 | IVLPIEWQQD | 20 |
| 120 | PVLPHTNGVG | 20 |
| 176 | KLTQEQKSKH | 20 |
| 83 | SQIPVVGVVT | 18 |
| 84 | QIPVVGVVTE | 18 |
| 156 | SLGEFLGSGT | 18 |
| 167 | MKLETIILSK | 18 |
| 3 | SIVILDLSVE | 17 |
| 6 | ILDLSVEVLA | 17 |
| 28 | ILRGGLSEIV | 17 |
| 74 | GIRNKSSSSS | 17 |
| 90 | VVTEDDEAQD | 17 |
| 121 | VLPHTNGVGP | 17 |
| 138 | LLKSQAASGT | 17 |
| 27 | NILRGGLSEI | 16 |
| 100 | SIDPPESPDR | 16 |
| 110 | ALKAANSWRN | 16 |
| 168 | KLETIILSKL | 16 |
| 171 | TIILSKLTQE | 16 |
| 5 | VILDLSVEVL | 15 |
| 8 | DLSVEVLASP | 15 |
| 26 | ANILRGGLSE | 15 |
| 37 | VLPIEYQQDR | 15 |
| 135 | LLRLLKSQAA | 15 |
| 147 | TLSLAFTSWS | 15 |
| 149 | SLAFTSWSLG | 15 |
| 159 | EFLGSGTWMK | 15 |
| 175 | SKLTQEQKSK | 15 |
| 38 | LPIEWQQDRK | 14 |
| 47 | KIPPLSTPPP | 14 |

TABLE XXXVII-continued

V7C-HLA-A3-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 103 | PPESPDRALK | 14 |
| 109 | RALKAANSWR | 14 |
| 131 | LWEFLLRLLK | 14 |
| 127 | GVGPLWEFLL | 13 |
| 143 | AASGTLSLAF | 13 |

TABLE XXXVII

V8-HLA-A3-10mers-98P4B6
Each peptide is a portion of SEQ ID NO: 17; each start position is specified, the length of peptide is 10 amino acids, and the end position for each peptide is the start position plus nine.

| Pos | 1234567890 | score |
|---|---|---|
| 5 | FLEEGMGGTI | 19 |

TABLE XXXVII

V13-HLA-A3-10mers-98P4B6
Each peptide is a portion of SEQ ID NO: 27; each start position is specified, the length of peptide is 10 amino acids, and the end position for each peptide is the start position plus nine.

| Pos | 1234567890 | score |
|---|---|---|
| 10 | FLPNGINGIK | 22 |
| 5 | SLSETFLPNG | 12 |

TABLE XXXVII

V14-HLA-A3-10mers-98P4B6
Each peptide is a portion of SEQ ID NO: 29; each start position is specified, the length of peptide is 10 amino acids, and the end position for each peptide is the start position plus nine.

| Pos | 1234567890 | score |
|---|---|---|
| 6 | RLFTFWRGPV | 16 |
| 4 | PLRLFTFWRG | 14 |
| 1 | ENLPLRLFTF | 13 |
| 2 | NLPLRLFTFW | 12 |
| 9 | TFWRGPVVVA | 11 |
| 3 | LPLRLFTFWR | 10 |
| 10 | FWRGPVVVAI | 10 |

TABLE XXXVII-continued

V14-HLA-A3-10mers-98P4B6
Each peptide is a portion of SEQ ID NO: 29; each start position is specified, the length of peptide is 10 amino acids, and the end position for each peptide is the start position plus nine.

| Pos | 1234567890 | score |
|---|---|---|
| 8 | FTFWRGPVVV | 9 |
| 7 | LFTFWRGPVV | 7 |

TABLE XXXVII

V21-HLA-A3-10mers-98P4B6
Each peptide is a portion of SEQ ID NO: 43; each start position is specified, the length of peptide is 10 amino acids, and the end position for each peptide is the start position plus nine.

| Pos | 1234567890 | score |
|---|---|---|
| 3 | KLTQEQKTKH | 18 |
| 2 | SKLTQEQKTK | 17 |

TABLE XXXVII

V25-HLA-A3-10mers-98P4B6
Each peptide is a portion of SEQ ID NO: 51; each start position is specified, the length of peptide is 10 amino acids, and the end position for each peptide is the start position plus nine.

| Pos | 1234567890 | score |
|---|---|---|
| 2 | ILFLPCISQK | 29 |
| 4 | FLPCISQKLK | 20 |
| 7 | CISQKLKRIK | 18 |
| 1 | IILFLPCISQ | 14 |

TABLE XXXVII

V1-HLA-A26-10mers-98P4B6
Each peptide is a portion of SEQ ID NO: 3; each start position is specified, the length of peptide is 10 amino acids, and the end position for each peptide is the start position plus nine.

| Pos | 1234567890 | score |
|---|---|---|
| 216 | VVVAISLATF | 27 |
| 296 | ETWLQCRKQL | 27 |
| 200 | EIENLPLRLF | 26 |
| 147 | NVVSAWALQL | 25 |
| 351 | EEEVWRIEMY | 25 |
| 202 | ENLPLRLFTL | 24 |
| 56 | VVIGSRNPKF | 23 |
| 127 | ESNAEYLASL | 23 |
| 427 | YTPPNFVLAL | 23 |

TABLE XXXVII-continued

V1-HLA-A26-10mers-98P4B6
Each peptide is a portion of SEQ ID NO: 3; each start position is specified, the length of peptide is 10 amino acids, and the end position for each peptide is the start position plus nine.

| Pos | 1234567890 | score |
|---|---|---|
| 440 | SIVILDLLQL | 23 |
| 45 | LTIRIIRCGY | 22 |
| 234 | DVIHPYARNQ | 22 |
| 253 | EIVNKTLPIV | 22 |
| 260 | PIVAITLLSL | 22 |
| 329 | ERYLFLNMAY | 21 |
| 15 | ETCLPNGING | 20 |
| 32 | TVGVIGSGDF | 20 |
| 98 | YTSLWDLRHL | 20 |
| 353 | EVWRIEMYIS | 20 |
| 68 | EFFPHVVDVT | 19 |
| 75 | DVTHHEDALT | 19 |
| 115 | DVSNNMRINQ | 19 |
| 186 | NFIPIDLGSL | 19 |
| 230 | SFVRDVIHPY | 19 |
| 257 | KTLPIVAITL | 19 |
| 314 | MVHVAYSLCL | 19 |
| 364 | GIMSLGLLSL | 19 |
| 404 | LISTFHVLIY | 19 |
| 217 | VVAISLATFF | 18 |
| 359 | MYISFGIMSL | 18 |
| 399 | GYVALLISTF | 18 |
| 441 | IVILDLLQLC | 18 |
| 2 | ESISMMGSPK | 17 |
| 30 | KVTVGVIGSG | 17 |
| 40 | DFAKSLTIRL | 17 |
| 81 | DALTKTNIIF | 17 |
| 263 | AITLLSLVYL | 17 |
| 406 | STFHVLIYGW | 17 |
| 177 | QVIELARQLN | 16 |
| 215 | PVVVAISLAT | 16 |
| 269 | LVYLAGLLAA | 16 |
| 435 | ALVLPSIVIL | 16 |
| 436 | LVLPSIVILD | 16 |
| 34 | GVIGSGDFAK | 15 |

TABLE XXXVII-continued

V1-HLA-A26-10mers-98P4B6
Each peptide is a portion of SEQ ID NO: 3; each start position is specified, the length of peptide is 10 amino acids, and the end position for each peptide is the start position plus nine.

| Pos | 1234567890 | score |
|---|---|---|
| 72  | HVVDVTHHED | 15 |
| 116 | VSNNMRINQY | 15 |
| 142 | IVKGFNVVSA | 15 |
| 199 | REIENLPLRL | 15 |
| 250 | IPIEIVNKTL | 15 |
| 261 | IVAITLLSLV | 15 |
| 262 | VAITLLSLVY | 15 |
| 310 | FFFAMVHVAY | 15 |
| 377 | TSIPSVSNAL | 15 |
| 389 | REFSFIQSTL | 15 |
| 391 | FSFIQSTLGY | 15 |
| 432 | FVLALVLPSI | 15 |
| 31  | VTVGVIGSGD | 14 |
| 55  | HVVIGSRNPK | 14 |
| 89  | IFVAIHREHY | 14 |
| 103 | DLRHLLVGKI | 14 |
| 108 | LVGKILIDVS | 14 |
| 148 | VVSAWALQLG | 14 |
| 222 | LATFFFLYSF | 14 |
| 301 | CRKQLGLLSF | 14 |
| 352 | EEVWRIEMYI | 14 |
| 362 | SFGIMSLGLL | 14 |
| 417 | RAFEEEYYRF | 14 |
| 437 | VLPSIVILDL | 14 |
| 443 | ILDLLQLCRY | 14 |
| 27  | DARKVTVGVI | 13 |
| 74  | VDVTHHEDAL | 13 |
| 92  | AIHREHYTSL | 13 |
| 137 | FPDSLIVKGF | 13 |
| 172 | IQARQQVIEL | 13 |
| 176 | QQVIELARQL | 13 |
| 178 | VIELARQLNF | 13 |
| 218 | VAISLATFFF | 13 |
| 223 | ATFFFLYSFV | 13 |
| 258 | TLPIVAITLL | 13 |
| 299 | LQCRKQLGLL | 13 |

TABLE XXXVII-continued

V1-HLA-A26-10mers-98P4B6
Each peptide is a portion of SEQ ID NO: 3; each start position is specified, the length of peptide is 10 amino acids, and the end position for each peptide is the start position plus nine.

| Pos | 1234567890 | score |
|---|---|---|
| 302 | RKQLGLLSFF | 13 |
| 358 | EMYISFGIMS | 13 |
| 361 | ISFGIMSLGL | 13 |
| 365 | IMSLGLLSLL | 13 |
| 375 | AVTSIPSVSN | 13 |
| 376 | VTSIPSVSNA | 13 |
| 395 | QSTLGYVALL | 13 |
| 410 | VLIYGWKRAF | 13 |

TABLE XXXVIII

V2-HLA-A26-10mers-98P4B6
Each peptide is a portion of SEQ ID NO: 5; each start position is specified, the length of peptide is 10 amino acids, and the end position for each peptide is the start position plus nine.

| Pos | 1234567890 | score |
|---|---|---|
| 17 | FTPFSCLSLP | 13 |
| 16 | GFTPFSCLSL | 12 |
| 35 | PPCPADFFLY | 11 |
| 2  | GSPGLQALSL | 10 |
| 4  | PGLQALSLSL | 10 |
| 14 | SSGFTPFSCL | 10 |
| 22 | CLSLPSSWDY | 10 |
| 8  | ALSLSLSSGF | 9 |
| 11 | LSLSSGFTPF | 9 |
| 32 | RCPPPCPADF | 9 |
| 33 | CPPPCPADFF | 9 |
| 36 | PCPADFFLYF | 9 |
| 30 | DYRCPPPCPA | 8 |
| 34 | PPPCPADFFL | 8 |
| 7  | QALSLSLSSG | 7 |
| 18 | TPFSCLSLPS | 7 |
| 3  | SPGLQALSLS | 6 |

TABLE XXXVIII

V5A-HLA-A26-10mers-98P4B6
Each peptide is a portion of SEQ ID NO: 11; each start position is specified, the length of peptide is 10 amino acids, and the end position for each peptide is the start position plus nine.

| Pos | 1234567890 | score |
|---|---|---|
| 1 | ENLPLRLFTF | 24 |
| 8 | FTFWRGPVVV | 12 |

TABLE XXXVIII

V5B-HLA-A26-10mers-98P4B6
Each peptide is a portion of SEQ ID NO: 11; each start position is specified, the length of peptide is 10 amino acids, and the end position for each peptide is the start position plus nine.

| Pos | 1234567890 | score |
|---|---|---|
| 16 | DTQTELELEF | 25 |
| 22 | ELEFVFLLTL | 24 |
| 24 | EFVFLLTLLL | 23 |
| 20 | ELELEFVFLL | 22 |
| 18 | QTELELEFVF | 16 |
| 23 | LEFVFLLTLL | 16 |
| 4 | EFSFIQIFCS | 14 |
| 5 | FSFIQIFCSF | 13 |
| 2 | WREFSFIQIF | 12 |
| 12 | CSFADTQTEL | 12 |

TABLE XXXVIII

V6-HLA-A26-10mers-98P4B6
Each peptide is a portion of SEQ ID NO: 13; each start position is specified, the length of peptide is 10 amino acids, and the end position for each peptide is the start position plus nine.

| Pos | 1234567890 | score |
|---|---|---|
| 6 | IVILGKIILF | 27 |
| 5 | SIVILGKIIL | 18 |
| 38 | EGIGGTIPHV | 18 |
| 7 | VILGKIILFL | 17 |
| 1 | LVLPSIVILG | 16 |
| 46 | HVSPERVTVM | 15 |
| 42 | GTIPHVSPER | 13 |

TABLE XXXVIII

V7A-HLA-A26-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 8 | ETFLPNGING | 24 |

TABLE XXXVIII

V7B-HLA-A26-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 9 | QSTLGYVALL | 13 |
| 5 | MAYQQSTLGY | 11 |
| 3 | LNMAYQQSTL | 10 |
| 10 | STLGYVALLI | 10 |
| 8 | QQSTLGYVAL | 9 |

TABLE XXXVIII

V7C-HLA-A26-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 170 | ETIILSKLTQ | 24 |
| 12 | EVLASPAAAW | 21 |
| 35 | EIVLPIEWQQ | 19 |
| 102 | DPPESPDRAL | 19 |
| 127 | GVGPLWEFLL | 19 |
| 5 | VILDLSVEVL | 17 |
| 152 | FTSWSLGEFL | 17 |
| 69 | EAQESGIRNK | 16 |
| 105 | ESPDRALKAA | 16 |
| 89 | EVVTEDDEAQ | 15 |
| 133 | EFLLRLLKSQ | 15 |
| 151 | AFTSWSLGEF | 15 |
| 3 | SIVILDLSVE | 14 |
| 4 | IVILDLSVEV | 14 |
| 45 | DRKIPPLSTP | 14 |
| 86 | PVVGVVTEDD | 14 |
| 90 | VVTEDDEAQD | 14 |

TABLE XXXVIII-continued

V7C-HLA-A26-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 99 | DSIDPPESPD | 14 |
| 130 | PLWEFLLRLL | 14 |
| 168 | KLETIILSKL | 14 |
| 171 | TIILSKLTQE | 14 |
| 8 | DLSVEVLASP | 13 |
| 42 | WQQDRKIPPL | 13 |
| 93 | EDDEAQDSID | 13 |
| 122 | LPHTNGVGPL | 13 |
| 125 | TNGVGPLWEF | 13 |
| 129 | GPLWEFLLRL | 13 |
| 10 | SVEVLASPAA | 12 |
| 36 | IVLPIEWQQD | 12 |
| 72 | ESGIRNKSSS | 12 |
| 95 | DEAQDSIDPP | 12 |
| 120 | PVLPHTNGVG | 12 |
| 126 | NGVGPLWEFL | 12 |
| 41 | EWQQDRKIPP | 11 |
| 60 | WTEEAGATAE | 11 |
| 62 | EEAGATAEAQ | 11 |
| 63 | EAGATAEAQE | 11 |
| 66 | ATAEAQESGI | 11 |
| 96 | EAQDSIDPPE | 11 |
| 141 | SQAASGTLSL | 11 |
| 159 | EFLGSGTWMK | 11 |
| 180 | EQKSKHCMFS | 11 |

TABLE XXXVIII

V8-HLA-A26-10mers-98P4B6
Each peptide is a portion of SEQ ID NO: 17; each start position is specified, the length of peptide is 10 amino acids, and the end position for each peptide is the start position plus nine.

| Pos | 1234567890 | score |
|---|---|---|
| 8 | EGMGGTIPHV | 14 |
| 7 | EEGMGGTIPH | 11 |
| 1 | EKSQFLEEGM | 10 |
| 3 | SQFLEEGMGG | 6 |

TABLE XXXVIII

V13-HLA-A26-10mers-98P4B6
Each peptide is a portion of SEQ ID NO: 27; each start position is specified, the length of peptide is 10 amino acids, and the end position for each peptide is the start position plus nine.

| Pos | 1234567890 | score |
|---|---|---|
| 8 | ETFLPNGING | 24 |

TABLE XXXVIII

V14-HLA-A26-10mers-98P4B6
Each peptide is a portion of SEQ ID NO: 29; each start position is specified, the length of peptide is 10 amino acids, and the end position for each peptide is the start position plus nine.

| Pos | 1234567890 | score |
|---|---|---|
| 1 | ENLPLRLFTF | 24 |
| 8 | FTFWRGPVVV | 12 |

TABLE XXXVIII

V21-HLA-A26-10mers-98P4B6
Each peptide is a portion of SEQ ID NO: 43; each start position is specified, the length of peptide is 10 amino acids, and the end position for each peptide is the start position plus nine.

| Pos | 1234567890 | score |
|---|---|---|
| 4 | LTQEQKTKHC | 10 |
| 7 | EQKTKHCMFS | 10 |
| 8 | QKTKHCMFSL | 10 |
| 6 | QEQKTKHCMF | 9 |
| 9 | KTKHCMFSLI | 9 |

TABLE XXXVIII

V25-HLA-A26-10mers-98P4B6
Each peptide is a portion of SEQ ID NO: 43; each start position is specified, the length of peptide is 10 amino acids, and the end position for each peptide is the start position plus nine.

| Pos | 1234567890 | score |
|---|---|---|
| 2 | ILFLPCISQK | 10 |
| 3 | LFLPCISQKL | 10 |
| 6 | PCISQKLKRI | 9 |
| 1 | IILFLPCISQ | 6 |
| 9 | SQKLKRIKKG | 6 |
| 7 | GISQKLKRIK | 4 |

TABLE XXXIX

V1-HLA-B0702-10mers-98P4B6
Each peptide is a portion of SEQ ID NO: 3; each start position is specified, the length of peptide is 10 amino acids, and the end position for each peptide is the start position plus nine.

| Pos | 1234567890 | score |
|---|---|---|
| 429 | PPNFVLALVL | 23 |
| 438 | LPSIVILDLL | 22 |
| 9 | SPKSLSETCL | 21 |
| 250 | IPIEIVNKTL | 21 |
| 323 | LPMRRSERYL | 21 |
| 137 | FPDSLIVKGF | 18 |
| 428 | TPPNFVLALV | 17 |
| 125 | YPESNAEYLA | 16 |
| 214 | GPVVVAISLA | 16 |
| 219 | AISLATFFFL | 16 |
| 394 | IQSTLGYVAL | 16 |
| 36 | IGSGDFAKSL | 15 |
| 197 | SAREIENLPL | 15 |
| 325 | MRRSERYLFL | 15 |
| 361 | ISFGIMSLGL | 15 |
| 379 | IPSVSNALNW | 15 |
| 427 | YTPPNFVLAL | 15 |
| 211 | LWRGPVVVAI | 14 |
| 263 | AITLLSLVYL | 14 |
| 402 | ALLISTFHVL | 14 |
| 435 | ALVLPSIVIL | 14 |
| 40 | DFAKSLTIRL | 13 |
| 92 | AIHREHYTSL | 13 |
| 127 | ESNAEYLASL | 13 |
| 172 | IQARQQVIEL | 13 |
| 188 | IPIDLGSLSS | 13 |
| 195 | LSSAREIENL | 13 |
| 199 | REIENLPRL | 13 |
| 204 | LPLRLFTLWR | 13 |
| 259 | LPIVAITLLS | 13 |
| 260 | PIVAITLLSL | 13 |
| 266 | LLSLVYLAGL | 13 |
| 290 | RFPPWLETWL | 13 |
| 364 | GIMSLGLLSL | 13 |
| 365 | IMSLGLLSLL | 13 |

TABLE XXXIX-continued

V1-HLA-B0702-10mers-98P4B6
Each peptide is a portion of SEQ ID NO: 3; each start position is specified, the length of peptide is 10 amino acids, and the end position for each peptide is the start position plus nine.

| Pos | 1234567890 | score |
|---|---|---|
| 4 | ISMMGSPKSL | 12 |
| 18 | LPNGINGIKD | 12 |
| 70 | FPHVVDVTHI | 12 |
| 98 | YTSLWDLRHL | 12 |
| 142 | IVKGFNVVSA | 12 |
| 147 | NVVSAWALQL | 12 |
| 157 | GPKDASRQVY | 12 |
| 202 | ENLPLRLFTL | 12 |
| 257 | KTLPIVAITL | 12 |
| 273 | AGLLAAAYQL | 12 |
| 292 | PPWLETWLQC | 12 |
| 296 | ETWLQCRKQL | 12 |
| 298 | WLQCRKQLGL | 12 |
| 314 | MVHVAYSLCL | 12 |
| 377 | TSIPSVSNAL | 12 |
| 395 | QSTLGYVALL | 12 |
| 425 | RFYTPPNFVL | 12 |
| 437 | VLPSIVILDL | 12 |
| 440 | SIVILDLLQL | 12 |
| 26 | KDARKVTVGV | 11 |
| 27 | DARKVTVGVI | 11 |
| 49 | LIRCGYHVVI | 11 |
| 62 | NPKFASEFFP | 11 |
| 74 | VDVTHHEDAL | 11 |
| 95 | REHYTSLWDL | 11 |
| 99 | TSLWDLRHLL | 11 |
| 132 | YLASLFPDSL | 11 |
| 145 | GFNVVSAWAL | 11 |
| 183 | RQLNFIPIDL | 11 |
| 186 | NFIPIDLGSL | 11 |
| 201 | IENLPLRLFT | 11 |
| 213 | RGPVVVAISL | 11 |
| 237 | HPYARNQQSD | 11 |
| 252 | IEIVNKTLPI | 11 |
| 258 | TLPIVAITLL | 11 |

TABLE XXXIX-continued

V1-HLA-B0702-10mers-98P4B6
Each peptide is a portion of SEQ ID NO: 3; each start position is specified, the length of peptide is 10 amino acids, and the end position for each peptide is the start position plus nine.

| Pos | 1234567890 | score |
|---|---|---|
| 286 | TKYRRFPPWL | 11 |
| 291 | FPPWLETWLQ | 11 |
| 312 | FAMVHVAYSL | 11 |
| 362 | SFGIMSLGLL | 11 |
| 389 | REFSFIQSTL | 11 |

TABLE XXXIX

V2-HLA-B0702-10mers-98P4B6
Each peptide is a portion of SEQ ID NO: 5; each start position is specified, the length of peptide is 10 amino acids, and the end position for each peptide is the start position plus nine.

| Pos | 1234567890 | score |
|---|---|---|
| 34 | PPPCPADFFL | 21 |
| 33 | CPPPCPADFF | 18 |
| 2 | GSPGLQALSL | 14 |
| 16 | GFTPFSCLSL | 13 |
| 18 | TPFSCLSLPS | 13 |
| 4 | PGLQALSLSL | 12 |
| 14 | SSGFTPFSCL | 12 |
| 25 | LPSSWDYRCP | 12 |
| 35 | PPCPADFFLY | 12 |
| 3 | SPGLQALSLS | 11 |
| 8 | ALSLSLSSGF | 10 |
| 36 | PCPADFFLYF | 10 |

TABLE XXXIX

V5A-HLA-B0702-10mers-98P4B6
Each peptide is a portion of SEQ ID NO: 11; each start position is specified, the length of peptide is 10 amino acids, and the end position for each peptide is the start position plus nine.

| Pos | 1234567890 | score |
|---|---|---|
| 10 | FWRGPVVAI | 14 |
| 3 | LPLRLFTFWR | 11 |
| 9 | TFWRGPVVA | 10 |
| 6 | RLFTFWRGPV | 9 |
| 8 | FTFWRGPVVV | 9 |

TABLE XXXIX-continued

V5A-HLA-B0702-10mers-98P4B6
Each peptide is a portion of SEQ ID NO: 11; each start position is specified, the length of peptide is 10 amino acids, and the end position for each peptide is the start position plus nine.

| Pos | 1234567890 | score |
|---|---|---|
| 1 | ENLPLRLFTF | 8 |
| 7 | LFTFWRGPVV | 8 |

TABLE XXXIX

V5B-HLA-B0702-10mers-98P4B6
Each peptide is a portion of SEQ ID NO: 11; each start position is specified, the length of peptide is 10 amino acids, and the end position for each peptide is the start position plus nine.

| Pos | 1234567890 | score |
|---|---|---|
| 19 | TELELEFVFL | 14 |
| 24 | EFVFLLTLLL | 14 |
| 14 | FADTQTELEL | 13 |
| 22 | ELEFVFLLTL | 13 |
| 12 | CSFADTQTEL | 12 |
| 20 | ELELEFVFLL | 12 |
| 23 | LEFVFLLTLL | 11 |
| 1 | NWREFSFIQI | 9 |
| 8 | IQIFCSFADT | 9 |
| 21 | LELEFVFLLT | 9 |
| 10 | IFCSFADTQT | 8 |
| 16 | DTQTELELEF | 8 |
| 5 | FSFIQIFCSF | 7 |
| 6 | SFIQIFCSFA | 7 |
| 17 | TQTELELEFV | 7 |
| 18 | QTELELEFVF | 7 |
| 2 | WREESFIQIF | 6 |

TABLE XXXIX

V6-HLA-B0702-10mers-98P4B6
Each peptide is a portion of SEQ ID NO: 13; each start position is specified, the length of peptide is 10 amino acids, and the end position for each peptide is the start position plus nine.

| Pos | 1234567890 | score |
|---|---|---|
| 3 | LPSIVILGKI | 18 |
| 44 | IPHVSPERVT | 18 |

TABLE XXXIX-continued

V6-HLA-B0702-10mers-98P4B6
Each peptide is a portion of SEQ ID NO: 13; each start position is specified, the length of peptide is 10 amino acids, and the end position for each peptide is the start position plus nine.

| Pos | 1234567890 | score |
|---|---|---|
| 7 | VILGKIILFL | 15 |
| 27 | KKGWEKSQFL | 13 |
| 16 | LPCISRKLKR | 12 |
| 46 | HVSPERVTVM | 12 |
| 14 | LFLPCISRKL | 11 |
| 5 | SIVILGKIIL | 10 |
| 38 | EGIGGTIPHV | 10 |
| 26 | IKKGWEKSQF | 9 |
| 31 | EKSQFLEEGI | 9 |
| 45 | PHVSPERVTV | 9 |

TABLE XXXIX

V7A-HLA-B0702-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 2 | SPKSLSETFL | 22 |

TABLE XXXIX

V7B-HLA-B0702-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 8 | QQSTLGYVAL | 15 |
| 3 | LNMAYQQSTL | 12 |
| 9 | QSTLGYVALL | 12 |
| 10 | STLGYVALLI | 10 |
| 6 | AYQQSTLGYV | 8 |
| 7 | YQQSTLGYVA | 7 |

TABLE XXXIX

V7C-HLA-B0702-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 122 | LPHTNGVGPL | 22 |
| 129 | GPLWEFLLRL | 22 |
| 102 | DPPESPDRAL | 21 |
| 49 | PPLSTPPPPA | 18 |
| 55 | PPPAMWTEEA | 18 |
| 119 | NPVLPHTNGV | 17 |
| 141 | SQAASGTLSL | 15 |
| 143 | AASGTLSLAF | 15 |
| 29 | LRGGLSEIVL | 14 |
| 113 | AANSWRNPVL | 14 |
| 15 | ASPAAAWKCL | 13 |
| 48 | IPPLSTPPPP | 13 |
| 85 | LPVVGVVTED | 13 |
| 106 | SPDRALKAAN | 13 |
| 126 | NGVGPLWEFL | 13 |
| 152 | FTSWSLGEFL | 13 |
| 165 | TWMKLETIIL | 13 |
| 181 | QKSKHCMFSL | 13 |
| 1 | LPSIVILDLS | 12 |
| 5 | VILDLSVEVL | 12 |
| 16 | SPAAAWKCLG | 12 |
| 29 | AWKCLGANIL | 12 |
| 24 | LGANILRGGL | 12 |
| 42 | WQQDRKIPPL | 12 |
| 54 | PPPPAMWTEE | 12 |
| 56 | PPAMWTEEAG | 12 |
| 103 | PPESPDRALK | 12 |
| 127 | GVGPLWEFLL | 12 |
| 139 | LKSQAASGTL | 12 |
| 28 | ILRGGLSEIV | 11 |
| 44 | QDRKIPPLST | 11 |
| 53 | TPPPPAMWTE | 11 |
| 81 | SSSQIPVVGV | 11 |
| 104 | PESPDRALKA | 11 |
| 144 | ASGTLSLAFT | 11 |

TABLE XXXIX-continued

V7C-HLA-B0702-10mers-98P4B6
Each peptide is a portion of SEQ ID NO: 15;
each start position is specified, the
length of peptide is 10 amino acids, and
the end position for each peptide is the
start position plus nine.

| Pos | 1234567890 | score |
|---|---|---|
| 148 | LSLAFTSWSL | 11 |
| 160 | FLGSGTWMKL | 11 |
| 168 | KLETIILSKL | 11 |
| 6 | ILDLSVEVLA | 10 |
| 17 | PAAAWKCLGA | 10 |
| 19 | AAWKCLGANI | 10 |
| 31 | GGLSEIVLPI | 10 |
| 38 | LPIEWQQDRK | 10 |
| 50 | PLSTPPPPAM | 10 |
| 78 | KSSSSSQIPV | 10 |
| 79 | SSSSSQIPVV | 10 |
| 83 | SQIPVVGVVT | 10 |
| 112 | KAANSWRNPV | 10 |
| 130 | PLWEFLLRLL | 10 |

TABLE XXXIX

V8-HLA-B0702-10mers-98P4B6
Each peptide is a portion of SEQ ID NO: 17;
each start position is specified, the
length of peptide is 10 amino acids, and
the end position for each peptide is the
start position plus nine.

| Pos | 1234567890 | score |
|---|---|---|
| 8 | EGMGGTIPHV | 11 |
| 1 | EKSQFLEEGM | 9 |
| 4 | QFLEEGMGGT | 6 |
| 5 | FLEEGMGGTI | 6 |

TABLE XXXIX

V13-HLA-B0702-10mers-98P4B6
Each peptide is a portion of SEQ ID NO: 27;
each start position is specified, the
length of peptide is 10 amino acids, and
the end position for each peptide is the
start position plus nine.

| Pos | 1234567890 | score |
|---|---|---|
| 2 | SPKSLSETFL | 22 |

TABLE XXXIX

V14-HLA-B0702-10mers-98P4B6
Each peptide is a portion of SEQ ID NO: 29;
each start position is specified, the
length of peptide is 10 amino acids, and
the end position for each peptide is the
start position plus nine.

| Pos | 1234567890 | score |
|---|---|---|
| 10 | FWRGPVVVAI | 14 |
| 3 | LPLRLFTFWR | 11 |
| 9 | TFWRGPVVVA | 10 |
| 6 | RLFTFWRGPV | 9 |
| 8 | FTFWRGPVVV | 9 |
| 1 | ENLPLRLFTF | 8 |
| 7 | LFTFWRGPVV | 8 |

TABLE XXXIX

V21-HLA-B0702-10mers-98P4B6
Each peptide is a portion of SEQ ID NO: 43;
each start position is specified, the
length of peptide is 10 amino acids, and
the end position for each peptide is the
start position plus nine.

| Pos | 1234567890 | score |
|---|---|---|
| 8 | QKTKHGMFSL | 11 |
| 9 | KTKHCMFSLI | 8 |
| 6 | QEQKTKHCMF | 7 |
| 1 | LSKLTQEQKT | 6 |
| 5 | TQEQKTKHCM | 6 |

TABLE XXXIX

V25-HLA-B0702-10mers-98P4B6
Each peptide is a portion of SEQ ID NO: 51;
each start position is specified, the
length of peptide is 10 amino acids, and
the end position for each peptide is the
start position plus nine.

| Pos | 1234567890 | score |
|---|---|---|
| 5 | LPCISQKLKR | 12 |
| 3 | LFLPCISQKL | 11 |
| 6 | PCISQKLKRI | 6 |

TABLE XL

V1-HLA-B08-10mers-98P4B6

| Pos | 1234567890 | score |
|---|---|---|
| | NoResultsFound. | |

TABLE XL

V2-HLA-B08-10mers-98P4B6

| Pos | 1234567890 | score |
|---|---|---|

NoResultsFound.

TABLE XL

V5A-HLA-B08-10mers-98P4B6

| Pos | 1234567890 | score |
|---|---|---|

NoResultsFound.

TABLE XL

V5B-HLA-B08-10mers-98P4B6

| Pos | 1234567890 | score |
|---|---|---|

NoResultsFound.

TABLE XL

V6-HLA-B08-10mers-98P4B6

| Pos | 1234567890 | score |
|---|---|---|

NoResultsFound.

TABLE XL

V7A-HLA-B08-10mers-98P4B6

| Pos | 1234567890 | score |
|---|---|---|

NoResultsFound.

TABLE XL

V7B-HLA-B08-10mers-98P4B6

| Pos | 1234567890 | score |
|---|---|---|

NoResultsFound.

TABLE XL

V7C-HLA-B08-10mers-98P4B6

| Pos | 1234567890 | score |
|---|---|---|

NoResultsFound.

TABLE XL

V8-HLA-B08-10mers-98P4B6

| Pos | 1234567890 | score |
|---|---|---|

NoResultsFound.

TABLE XL

V13-HLA-B08-10mers-98P4B6

| Pos | 1234567890 | score |
|---|---|---|

NoResultsFound.

TABLE XL

V14-HLA-B08-10mers-98P4B6

| Pos | 1234567890 | score |
|---|---|---|

NoResultsFound.

TABLE XL

V21-HLA-B08-10mers-98P4B6

| Pos | 1234567890 | score |
|---|---|---|

NoResultsFound.

TABLE XL

V25-HLA-B08-10mers-98P4B6

| Pos | 1234567890 | score |
|---|---|---|

NoResultsFound.

TABLE XLI

V1-HLA-B1510-10mers-98P4B6

| Pos | 1234567890 | score |
|---|---|---|

NoResultsFound.

TABLE XLI

V2-HLA-B1510-10mers-98P4B6

| Pos | 1234567890 | score |
|---|---|---|

NoResultsFound.

TABLE XLI

V5A-HLA-B1510-10mers-98P4B6

| Pos | 1234567890 | score |
|---|---|---|
| NoResultsFound. | | |

TABLE XLI

V5B-HLA-B1510-10mers-98P4B6

| Pos | 1234567890 | score |
|---|---|---|
| NoResultsFound. | | |

TABLE XLI

V6-HLA-B1510-10mers-98P4B6

| Pos | 1234567890 | score |
|---|---|---|
| NoResultsFound. | | |

TABLE XLI

V7A-HLA-B1510-10mers-98P4B6

| Pos | 1234567890 | score |
|---|---|---|
| NoResultsFound. | | |

TABLE XLI

V7B-HLA-B1510-10mers-98P4B6

| Pos | 1234567890 | score |
|---|---|---|
| NoResultsFound. | | |

TABLE XLI

V7C-HLA-B1510-10mers-98P4B6

| Pos | 1234567890 | score |
|---|---|---|
| NoResultsFound. | | |

TABLE XLI

V8-HLA-B1510-10mers-98P4B6

| Pos | 1234567890 | score |
|---|---|---|
| NoResultsFound. | | |

TABLE XLI

V13-HLA-B1510-10mers-98P4B6

| Pos | 1234567890 | score |
|---|---|---|
| NoResultsFound. | | |

TABLE XLI

V14-HLA-B1510-10mers-98P4B6

| Pos | 1234567890 | score |
|---|---|---|
| NoResultsFound. | | |

TABLE XLI

V21-HLA-B1510-10mers-98P4B6

| Pos | 1234567890 | score |
|---|---|---|
| NoResultsFound. | | |

TABLE XLI

V25-HLA-B1510-10mers-98P4B6

| Pos | 1234567890 | score |
|---|---|---|
| NoResultsFound. | | |

TABLE XLI

V1-HLA-B2705-10mers-98P4B6

| Pos | 1234567890 | score |
|---|---|---|
| NoResultsFound. | | |

TABLE XLI

V2-HLA-B2705-10mers-98P4B6

| Pos | 1234567890 | score |
|---|---|---|
| NoResultsFound. | | |

TABLE XLI

V5A-HLA-B2705-10mers-98P4B6

| Pos | 1234567890 | score |
|---|---|---|
| NoResultsFound. | | |

TABLE XLI

V5B-HLA-B2705-10mers-98P4B6

| Pos | 1234567890 | score |
|---|---|---|
| NoResultsFound. | | |

TABLE XLI

V6-HLA-B2705-10mers-98P4B6

| Pos | 1234567890 | score |
|---|---|---|
| NoResultsFound. | | |

TABLE XLI

V7A-HLA-B2705-10mers-98P4B6

| Pos | 1234567890 | score |
|---|---|---|
| NoResultsFound. | | |

TABLE XLI

V7B-HLA-B2705-10mers-98P4B6

| Pos | 1234567890 | score |
|---|---|---|
| NoResultsFound. | | |

TABLE XLI

V7C-HLA-B2705-10mers-98P4B6

| Pos | 1234567890 | score |
|---|---|---|
| NoResultsFound. | | |

TABLE XLI

V8-HLA-B2705-10mers-98P4B6

| Pos | 1234567890 | score |
|---|---|---|
| NoResultsFound. | | |

TABLE XLI

V13-HLA-B2705-10mers-98P4B6

| Pos | 1234567890 | score |
|---|---|---|
| NoResultsFound. | | |

TABLE XLI

V14-HLA-B2705-10mers-98P4B6

| Pos | 1234567890 | score |
|---|---|---|
| NoResultsFound. | | |

TABLE XLI

V21-HLA-B2705-10mers-98P4B6

| Pos | 1234567890 | score |
|---|---|---|
| NoResultsFound. | | |

TABLE XLI

V25-HLA-B2705-10mers-98P4B6

| Pos | 1234567890 | score |
|---|---|---|
| NoResultsFound. | | |

TABLE XLI

V1-HLA-B2709-10mers-98P4B6

| Pos | 1234567890 | score |
|---|---|---|
| NoResultsFound. | | |

TABLE XLI

V2-HLA-B2709-10mers-98P4B6

| Pos | 1234567890 | score |
|---|---|---|
| NoResultsFound. | | |

TABLE XLI

V5A-HLA-B2709-10mers-98P4B6

| Pos | 1234567890 | score |
|---|---|---|
| NoResultsFound. | | |

TABLE XLI

V5B-HLA-B2709-10mers-98P4B6

| Pos | 1234567890 | score |
|---|---|---|
| NoResultsFound. | | |

TABLE XLI

V6-HLA-B2709-10mers-98P4B6

| Pos | 1234567890 | score |
|---|---|---|
| NoResultsFound. | | |

TABLE XLI

V7A-HLA-B2709-10mers-98P4B6

| Pos | 1234567890 | score |
|---|---|---|
| NoResultsFound. | | |

TABLE XLI

V7B-HLA-B2709-10mers-98P4B6

| Pos | 1234567890 | score |
|---|---|---|
| NoResultsFound. | | |

TABLE XLI

V7C-HLA-B2709-10mers-98P4B6

| Pos | 1234567890 | score |
|---|---|---|
| NoResultsFound. | | |

TABLE XLI

V8-HLA-B2709-10mers-98P4B6

| Pos | 1234567890 | score |
|---|---|---|
| NoResultsFound. | | |

TABLE XLI

V13-HLA-B2709-10mers-98P4B6

| Pos | 1234567890 | score |
|---|---|---|
| NoResultsFound. | | |

TABLE XLI

V14-HLA-B2709-10mers-98P4B6

| Pos | 1234567890 | score |
|---|---|---|
| NoResultsFound. | | |

TABLE XLI

V21-HLA-B2709-10mers-98P4B6

| Pos | 1234567890 | score |
|---|---|---|
| NoResultsFound. | | |

TABLE XLI

V25-HLA-B2709-10mers-98P4B6

| Pos | 1234567890 | score |
|---|---|---|
| NoResultsFound. | | |

TABLE XLIV

V1-HLA-B4402-10mers-98P4B6

Each peptide is a portion of SEQ ID NO: 3; each start position is specified, the length of peptide is 10 amino acids, and the end position for each peptide is the start position plus nine.

| Pos | 1234567890 | score |
|---|---|---|
| 199 | REIENLPLRL | 25 |
| 351 | EEEVWRIEMY | 25 |
| 252 | IEIVNKTLPI | 23 |
| 389 | REFSFIQSTL | 23 |
| 95 | REHYTSLWDL | 21 |
| 179 | IELARQLNFI | 21 |
| 352 | EEVWRIEMYI | 20 |
| 79 | HEDALTKTNI | 19 |
| 377 | TSLPSVSNAL | 19 |
| 186 | NFIPIDLGSL | 18 |
| 202 | ENLPLRLFTL | 18 |
| 257 | KTLPIVAITL | 18 |
| 427 | YTPPNFVLAL | 18 |
| 435 | ALVLPSIVIL | 18 |
| 273 | AGLLAAAYQL | 17 |
| 289 | RRFPPWLETW | 17 |
| 296 | ETWLQCRKQL | 17 |
| 402 | ALLISTFHVL | 17 |
| 16 | TCLPNGINGI | 16 |
| 116 | VSNNMRINQY | 16 |
| 200 | EIENLPLRLF | 16 |
| 219 | AISLATFFFL | 16 |
| 230 | SFVRDVIHPY | 16 |
| 250 | IPIEIVNKTL | 16 |
| 262 | VAITLLSLVY | 16 |
| 263 | AITLLSLVYL | 16 |
| 359 | MYISFGIMSL | 16 |
| 406 | STFHVLIYGW | 16 |
| 410 | VLIYGWKRAF | 16 |
| 36 | IGSGDFAKSL | 15 |

TABLE XLIV-continued

V1-HLA-B4402-10mers-98P4B6
Each peptide is a portion of SEQ ID NO: 3; each start position is specified, the length of peptide is 10 amino acids, and the end position for each peptide is the start position plus nine.

| Pos | 1234567890 | score |
|---|---|---|
| 45 | LTIRLIRCGY | 15 |
| 56 | VVIGSRNPKF | 15 |
| 60 | SRNPKFASEF | 15 |
| 67 | SEFFPHVVDV | 15 |
| 126 | PESNAEYLAS | 15 |
| 130 | AEYLASLFPD | 15 |
| 203 | NLPLRLFTLW | 15 |
| 255 | VNKTLPIVAI | 15 |
| 258 | TLPIVAITLL | 15 |
| 279 | AYQLYYGTKY | 15 |
| 310 | FFFAMVHVAY | 15 |
| 329 | ERYLFLNMAY | 15 |
| 394 | IQSTLGYVAL | 15 |
| 437 | VLPSIVILDL | 15 |
| 4 | ISMMGSPKSL | 14 |
| 92 | AIHREHYTSL | 14 |
| 98 | YTSLWDLRHL | 14 |
| 99 | TSLWDLRHLL | 14 |
| 123 | NQYPESNAEY | 14 |
| 137 | FPDSLIVKGF | 14 |
| 147 | NVVSAWALQL | 14 |
| 183 | RQLNFIPIDL | 14 |
| 195 | LSSAREIENL | 14 |
| 218 | VAISLATFFF | 14 |
| 271 | YLAGLLAAAY | 14 |
| 290 | RFPPWLETWL | 14 |
| 346 | ENSWNEEEVW | 14 |
| 361 | ISFGIMSLGL | 14 |
| 365 | IMSLGLLSLL | 14 |
| 391 | FSFIQSTLGY | 14 |
| 396 | STLGYVALLI | 14 |
| 399 | GYVALLISTF | 14 |
| 404 | LISTFHVLIY | 14 |
| 418 | AFEEEYYRFY | 14 |
| 420 | EEEYYRFYTP | 14 |
| 440 | SIVILDLLQL | 14 |
| 41 | FAKSLTIRLI | 13 |
| 74 | VDVTHHEDAL | 13 |
| 80 | EDALTKTNII | 13 |
| 81 | DALTKTNIIF | 13 |
| 84 | TKTNIIFVAI | 13 |
| 104 | LRHLLVGKIL | 13 |
| 127 | ESNAEYLASL | 13 |
| 128 | SNAEYLASLF | 13 |
| 143 | VKGFNVVSAW | 13 |
| 145 | GFNVVSAWAL | 13 |
| 157 | GPKDASRQVY | 13 |
| 170 | NNIQARQQVI | 13 |
| 172 | IQARQQVIEL | 13 |
| 176 | QQVIELARQL | 13 |
| 201 | IENLPLRLFT | 13 |
| 211 | LWRGPVVVAI | 13 |
| 213 | RGPVVVAISL | 13 |
| 220 | ISLATFFFLY | 13 |
| 245 | SDFYKIPIEI | 13 |
| 266 | LLSLVYLAGL | 13 |
| 267 | LSLVYLAGLL | 13 |
| 299 | LQCRKQLGLL | 13 |
| 303 | KQLGLLSFFF | 13 |
| 323 | LPMRRSERYL | 13 |
| 324 | PMRRSERYLF | 13 |
| 328 | SERYLFLNMA | 13 |
| 350 | NEEEVWRIEM | 13 |
| 362 | SFGIMSLGLL | 13 |
| 364 | GIMSLGLLSL | 13 |
| 379 | IPSVSNALNW | 13 |
| 384 | NALNWREFSF | 13 |
| 395 | QSTLGYVALL | 13 |
| 403 | LLISTFHVLI | 13 |
| 429 | PPNFVLALVL | 13 |
| 438 | LPSIVILDLL | 13 |

TABLE XLIV-continued

V1-HLA-B4402-10mers-98P4B6
Each peptide is a portion of SEQ ID NO: 3; each start position is specified, the length of peptide is 10 amino acids, and the end position for each peptide is the start position plus nine.

| Pos | 1234567890 | score |
|---|---|---|
| 443 | ILDLLQLCRY | 13 |
| 38 | SGDFAKSLTI | 12 |
| 40 | DFAKSLTIRL | 12 |
| 93 | IHREHYTSLW | 12 |
| 105 | RHLLVGKILI | 12 |
| 124 | QYPESNAEYL | 12 |
| 178 | VIELARQLNE | 12 |
| 192 | LGSLSSAREI | 12 |
| 197 | SAREIENLPL | 12 |
| 216 | VVVAISLATF | 12 |
| 260 | PIVAITLLSL | 12 |
| 274 | GLLAAAYQLY | 12 |
| 282 | LYYGTKYRRF | 12 |
| 286 | TKYRRFPPWL | 12 |
| 295 | LETWLQCRKQ | 12 |
| 301 | CRKQLGLLSF | 12 |
| 302 | RKQLGLLSFF | 12 |
| 312 | FAMVHVAYSL | 12 |
| 357 | IEMYISFGIM | 12 |
| 385 | ALNWREFSFI | 12 |
| 417 | RAFEEEYYRF | 12 |
| 421 | EEYYRFYTPP | 12 |
| 425 | RFYTPPNFVL | 12 |

TABLE XLIV

V2-HLA-B4402-10mers-98P4B6
Each peptide is a portion of SEQ ID NO: 5; each start position is specified, the length of peptide is 10 amino acids, and the end position for each peptide is the start position plus nine.

| Pos | 1234567890 | score |
|---|---|---|
| 8 | ALSLSLSSGF | 15 |
| 32 | RCPPPCPADF | 15 |
| 33 | CPPPCPADFF | 15 |
| 35 | PPCPADFFLY | 15 |

TABLE XLIV-continued

V2-HLA-B4402-10mers-98P4B6
Each peptide is a portion of SEQ ID NO: 5; each start position is specified, the length of peptide is 10 amino acids, and the end position for each peptide is the start position plus nine.

| Pos | 1234567890 | score |
|---|---|---|
| 2 | GSPGLQALSL | 14 |
| 16 | GFTPFSCLSL | 14 |
| 36 | PCPADFFLYF | 13 |
| 4 | PGLQALSLSL | 12 |
| 11 | LSLSSGFTPF | 12 |
| 14 | SSGFTPFSCL | 12 |
| 20 | FSCLSLPSSW | 12 |
| 22 | CLSLPSSWDY | 12 |
| 34 | PPPCPADFFL | 11 |

TABLE XLIV

V5A-HLA-B4402-10mers-98P4B6
Each peptide is a portion of SEQ ID NO: 11; each start position is specified, the length of peptide is 10 amino acids, and the end position for each peptide is the start position plus nine.

| Pos | 1234567890 | score |
|---|---|---|
| 1 | ENLPLRLFTF | 18 |
| 2 | NLPLRLFTFW | 14 |
| 10 | FWRGPVVVAI | 13 |

TABLE XLIV

V5B-HLA-B4402-10mers-98P4B6
Each peptide is a portion of SEQ ID NO: 11; each start position is specified, the length of peptide is 10 amino acids, and the end position for each peptide is the start position plus nine.

| Pos | 1234567890 | score |
|---|---|---|
| 23 | LEFVFLLTLL | 24 |
| 19 | TELELEFVFL | 23 |
| 20 | ELELEFVFLL | 15 |
| 22 | ELEFVFLLTL | 15 |
| 24 | EFVFLLTLLL | 15 |

TABLE XLIV-continued

V5B-HLA-B4402-10mers-98P4B6
Each peptide is a portion of SEQ ID NO: 11; each start position is specified, the length of peptide is 10 amino acids, and the end position for each peptide is the start position plus nine.

| Pos | 1234567890 | score |
|---|---|---|
| 21 | LELEFVFLLT | 14 |
| 2 | WREFSFIQIF | 13 |
| 3 | REFSFIQIFC | 13 |
| 5 | FSFIQIFCSF | 13 |
| 14 | FADTQTELEL | 13 |
| 1 | NWREFSFIQI | 12 |
| 12 | CSFADTQTEL | 12 |
| 16 | DTQTELELEF | 12 |
| 18 | QTELELEFVF | 12 |

TABLE XLIV

V6-HLA-B4402-10mers-98P4B6
Each peptide is a portion of SEQ ID NO: 13; each start position is specified, the length of peptide is 10 amino acids, and the end position for each peptide is the start position plus nine.

| Pos | 1234567890 | score |
|---|---|---|
| 6 | IVILGKIILF | 19 |
| 7 | VILGKIILFL | 16 |
| 14 | LFLPCISRKL | 16 |
| 17 | PCISRKLKRI | 14 |
| 37 | EEGIGGTIPH | 14 |
| 4 | PSIVILGKII | 13 |
| 21 | RKLKRIKKGW | 13 |
| 5 | SIVILGKIIL | 12 |
| 10 | GKIILFLPCI | 12 |
| 26 | IKKGWEKSQF | 12 |
| 3 | LPSIVILGKI | 11 |
| 27 | KKGWEKSQFL | 11 |
| 30 | WEKSQFLEEG | 11 |
| 31 | EKSQFLEEGI | 11 |
| 36 | LEEGIGGTIP | 11 |

TABLE XLIV-continued

V6-HLA-B4402-10mers-98P4B6
Each peptide is a portion of SEQ ID NO: 13; each start position is specified, the length of peptide is 10 amino acids, and the end position for each peptide is the start position plus nine.

| Pos | 1234567890 | score |
|---|---|---|
| 35 | FLEEGIGGTI | 9 |
| 38 | EGIGGTIPHV | 9 |

TABLE XLIV

V7A-HLA-B4402-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 9 | TFLPNGINGI | 16 |
| 1 | GSPKSLSETF | 12 |
| 2 | SPKSLSETFL | 11 |
| 6 | LSETFLPNGI | 11 |
| 7 | SETFLPNGIN | 11 |

TABLE XLIV

V7B-HLA-B4402-10mers-98P4B6
Each peptide is a portion of SEQ ID NO: 15; each start position is specified, the length of peptide is 10 amino acids, and the end position for each peptide is the start position plus nine.

| Pos | 1234567890 | score |
|---|---|---|
| 8 | QQSTLGYVAL | 15 |
| 10 | STLGYVALLI | 14 |
| 9 | QSTLGYVALL | 13 |
| 3 | LNMAYQQSTL | 12 |
| 5 | MAYQQSTLGY | 12 |

TABLE XLIV

V7C-HLA-B4402-
10mers-98P4B6
Each peptide is a portion of
SEQ ID NO: 15; each start
position is specified, the
length of peptide is 10 amino
acids, and the end position
for each peptide is the start
position plus nine.

| Pos | 1234567890 | score |
|---|---|---|
| 92 | TEDDEAQDSI | 20 |
| 179 | QEQKSKHCMF | 20 |
| 143 | AASGTLSLAF | 18 |
| 34 | SEIVLPIEWQ | 17 |
| 104 | PESPDRALKA | 17 |
| 12 | EVLASPAAAW | 16 |
| 15 | ASPAAAWKCL | 16 |
| 62 | EEAGATAEAQ | 16 |
| 132 | WEFLLRLLKS | 16 |
| 20 | AWKCLGANIL | 15 |
| 5 | VILDLSVEVL | 14 |
| 11 | VEVLASPAAA | 14 |
| 42 | WQQDRKIPPL | 14 |
| 51 | LSTPPPPAMW | 14 |
| 68 | AEAQESGIRN | 14 |
| 71 | QESGIRNKSS | 14 |
| 102 | DPPESPDRAL | 14 |
| 113 | AANSWRNPVL | 14 |
| 127 | GVGPLWEFLL | 14 |
| 151 | AFTSWSLGEF | 14 |
| 168 | KLETIILSKL | 14 |
| 29 | LRGGLSEIVL | 13 |
| 40 | IEWQQDRKIP | 13 |
| 95 | DEAQDSIDPP | 13 |
| 108 | DRALKAANSW | 13 |
| 129 | GPLWEFLLRL | 13 |
| 130 | PLWEFLLRLL | 13 |
| 141 | SQAASGTLSL | 13 |
| 158 | GEFLGSGTWM | 13 |
| 165 | TWMKLETIIL | 13 |
| 169 | LETIILSKLT | 13 |
| 24 | LGANILRGGL | 12 |
| 27 | NILRGGLSEI | 12 |
| 33 | LSEIVLPIEW | 12 |

TABLE XLIV-continued

V7C-HLA-B4402-
10mers-98P4B6
Each peptide is a portion of
SEQ ID NO: 15; each start
position is specified, the
length of peptide is 10 amino
acids, and the end position
for each peptide is the start
position plus nine.

| Pos | 1234567890 | score |
|---|---|---|
| 122 | LPHTNGVGPL | 12 |
| 123 | PHTNGVGPLW | 12 |
| 126 | NGVGPLWEFL | 12 |
| 139 | LKSQAASGTL | 12 |
| 146 | GTLSLAFTSW | 12 |
| 19 | AAWKCLGANI | 11 |
| 31 | GGLSEIVLPI | 11 |
| 61 | TEEAGATAEA | 11 |
| 66 | ATAEAQESGI | 11 |
| 125 | TNGVGPLWEF | 11 |
| 148 | LSLAFTSWSL | 11 |
| 152 | FTSWSLGEFL | 11 |
| 157 | LGEFLGSGTW | 11 |
| 160 | FLGSGTWMKL | 11 |
| 163 | SGTWMKLETI | 11 |
| 181 | QKSKHCMFSL | 11 |
| 182 | KSKHCMFSLI | 11 |
| 39 | PIEWQQDRKI | 10 |
| 76 | RNKSSSSSQI | 9 |
| 83 | SQIPVVGVVT | 9 |
| 105 | ESPDRALKAA | 9 |

TABLE XLIV

V8-HLA-B4402-
10mers-98P4B6
Each peptide is a portion of
SEQ ID NO: 17; each start
position is specified, the
length of peptide is 10 amino
acids, and the end position
for each peptide is the start
position plus nine.

| Pos | 1234567890 | score |
|---|---|---|
| 7 | EEGMGGTIPH | 14 |
| 6 | LEEGMGGTIP | 11 |
| 5 | FLEEGMGGTI | 9 |
| 8 | EGMGGTIPHV | 7 |

TABLE XLIV

V13-HLA-B4402-
10mers-98P4B6
Each peptide is a portion of
SEQ ID NO: 27; each start
position is specified, the
length of peptide is 10 amino
acids, and the end position
for each peptide is the start
position plus nine.

| Pos | 1234567890 | score |
|---|---|---|
| 9 | TFLPNGINGI | 16 |
| 1 | GSPKSLSETF | 12 |
| 2 | SPKSLSETFL | 11 |
| 6 | LSETFLPNGI | 11 |
| 7 | SETFLPNGIN | 11 |

TABLE XLIV

V14-HLA-B4402-
10mers-98P4B6
Each peptide is a portion of
SEQ ID NO: 29; each start
position is specified, the
length of peptide is 10 amino
acids, and the end position
for each peptide is the start
position plus nine.

| Pos | 1234567890 | score |
|---|---|---|
| 1 | ENLPLRLFTF | 18 |
| 2 | NLPLRLFTFW | 14 |
| 10 | FWRGPVVVAI | 13 |

TABLE XLIV

V21-HLA-B4402-
10mers-98P4B6
Each peptide is a portion of
SEQ ID NO: 43; each start
position is specified, the
length of peptide is 10 amino
acids, and the end position
for each peptide is the start
position plus nine.

| Pos | 1234567890 | score |
|---|---|---|
| 6 | QEQKTKHCMF | 20 |
| 9 | KTKHCMFSLI | 11 |
| 8 | QKTKHCMFSL | 10 |

TABLE XLIV

V25-HLA-B4402-10mers-98PB36
Each peptide is a portion of SEQ ID NO: 51; each
start position is specified, the length of peptide
is 10 amino acids, and the end position for each
peptide is the start position plus nine.

| Pos | 1234567890 | score |
|---|---|---|
| 3 | LFLPCISQKL | 15 |
| 6 | PCISQKLKRI | 14 |
| 10 | QKLKRIKKGW | 13 |
| 9 | SQKLKRIKKG | 8 |
| 2 | ILFLPCISQK | 7 |

TABLE XLV

V1-HLA-B5101-10mers-98P4B6

| Pos | 1234567890 | score |
|---|---|---|
| NoResultsFound. | | |

TABLE XLV

V2-HLA-B5101-10mers-98P4B6

| Pos | 1234567890 | score |
|---|---|---|
| NoResultsFound. | | |

TABLE XLV

V5A-HLA-B5101-10mers-98P4B6

| Pos | 1234567890 | score |
|---|---|---|
| NoResultsFound. | | |

TABLE XLV

V5B-HLA-B5101-10mers-98P4B6

| Pos | 1234567890 | score |
|---|---|---|
| NoResultsFound. | | |

TABLE XLV

V6-HLA-B5101-10mers-98P4B6

| Pos | 1234567890 | score |
|---|---|---|
| NoResultsFound. | | |

TABLE XLV

V7A-HLA-B5101-10mers-98P4B6

| Pos | 1234567890 | score |
|---|---|---|
| NoResultsFound. | | |

TABLE XLV

V7B-HLA-B5101-10mers-98P4B6

| Pos | 1234567890 | score |
|---|---|---|
| NoResultsFound. | | |

TABLE XLV

V7C-HLA-B5101-10mers-98P4B6

| Pos | 1234567890 | score |
|---|---|---|
| NoResultsFound. | | |

TABLE XLV

V8-HLA-B5101-10mers-98P4B6

| Pos | 1234567890 | score |
|---|---|---|
| NoResultsFound. | | |

TABLE XLV

V13-HLA-B5101-10mers-98P4B6

| Pos | 1234567890 | score |
|---|---|---|
| NoResultsFound. | | |

TABLE XLV

V14-HLA-B5101-10mers-98P4B6

| Pos | 1234567890 | score |
|---|---|---|
| NoResultsFound. | | |

TABLE XLV

V21-HLA-B5101-10mers-98P4B6

| Pos | 1234567890 | score |
|---|---|---|
| NoResultsFound. | | |

TABLE XLV

V25-HLA-B5101-10mers-98P4B6

| Pos | 1234567890 | score |
|---|---|---|
| NoResultsFound. | | |

TABLE XLVI

V1-HLA-DRB1-0101-15mers-98P4B6

Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 143 | VKGFNVVDSAWLQLG | 33 |
| 266 | LLSLVYLAGLLAAAY | 33 |
| 367 | SLGLLSLLAVTSIPS | 32 |
| 1 | MESISMMGSPKSLSE | 31 |
| 130 | AEYLASLFPDSLIVK | 30 |
| 30 | KVTVGVIGSGDFAKS | 29 |
| 431 | NFVLALVLPSIVILD | 29 |
| 206 | LRLFTLWRGPVVVAI | 28 |
| 215 | PVVVAISLATFFFLY | 28 |
| 370 | LLSLLAVTSIPSVSN | 28 |
| 438 | LPSIVILDLLQLCRY | 28 |
| 101 | LWDLRHLLVGKILID | 27 |
| 185 | LNFIPIDLGSLSSAR | 27 |
| 356 | RIEMYISFGIMSLGL | 27 |
| 360 | YISFGIMSLGLLSLL | 27 |
| 397 | TLGYVALLISTFHVL | 27 |
| 421 | EEYYRFYTPPNFVLA | 27 |
| 38 | SGDFAKSLTIRLIRC | 26 |
| 102 | WDLRHLLVGKILIDV | 26 |
| 122 | INQYPESNAEYLASL | 26 |
| 149 | VSAWALQLGPKDASR | 26 |
| 244 | QSDFYKIPIEIVNKT | 26 |
| 249 | KIPIEIVNKTLPIVA | 26 |
| 256 | NKTLPIVAITLLSLV | 26 |
| 261 | IVAITLLSLVYLAGL | 26 |
| 298 | WLQCRKQLGLLSFFF | 26 |
| 368 | LGLLSLLAVTSIPSV | 26 |
| 109 | VGKILIDVSNNMRIN | 25 |
| 137 | FPDSLIVKGFNVVSA | 25 |
| 145 | GFNVVSAWALQLGPK | 25 |
| 198 | AREIENLPLRLFTLW | 25 |
| 222 | LATFFFLYSFVRDVI | 25 |
| 252 | IEIVNKTLPIVAITL | 25 |
| 264 | ITLLSLVYLAGLLAA | 25 |
| 302 | RKQLGLLSFFFAMVH | 25 |

TABLE XLVI-continued

V1-HLA-DRB1-0101-15mers-98P4B6

Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 309 | SFFFAMVHVAYSLCL | 25 |
| 354 | VWRIEMYISFGIMSL | 25 |
| 362 | SFGIMSLGLLSLLAV | 25 |
| 365 | IMSLGLLSLLAVTSI | 25 |
| 51 | RCGYHVVIGSRNPKF | 24 |
| 98 | YTSLWDLRHLLVGKI | 24 |
| 106 | HLLVGKILIDVSNNM | 24 |
| 150 | SAWALQLGPKDASRQ | 24 |
| 184 | QLNFIPIDLGSLSSA | 24 |
| 205 | PLRLFTLWRGPVVVA | 24 |
| 229 | YSFVRDVIHPYARNQ | 24 |
| 269 | LVYLAGLLAAAYQLY | 24 |
| 330 | RYLFLNMAYQQVHAN | 24 |
| 335 | NMAYQQVHANIENSW | 24 |
| 388 | WREFSFIQSTLGYVA | 24 |
| 391 | FSFIQSTLGYVALLI | 24 |
| 398 | LGYVALLISTFHVLI | 24 |
| 427 | YTPPNFVLALVLPSI | 24 |
| 430 | PNFVLALVLPSIVIL | 24 |
| 52 | CGYHVVIGSRNPKFA | 23 |
| 55 | HVVIGSRNPKFASEF | 23 |
| 186 | NFIPIDLGSLSSARE | 23 |
| 214 | GPVVVAISLATFFFL | 23 |
| 258 | TLPIVAITLLSLVYL | 23 |
| 351 | EEEVWRIEMYISFGI | 23 |
| 352 | EEVWRIEMYISFGIM | 23 |
| 127 | ESNAEYLASLFPDSL | 22 |
| 178 | VIELARQLNFIPIDL | 22 |
| 189 | PIDLGSLSSAREIEN | 22 |
| 211 | LWRGPVVVAISLATF | 22 |
| 216 | VVVAISLATFFFLYS | 22 |
| 255 | VNKTLPIVAITLLSL | 22 |
| 301 | CRKQLGLLSFFFAMV | 22 |
| 312 | FAMVHVAYSLCPMR | 22 |
| 359 | MYISFGIMSLGLLSL | 22 |
| 364 | GIMSLGLLSLLAVTS | 22 |
| 395 | QSTLGYVALLISTFH | 22 |
| 432 | FVLALVLPSIVILDL | 22 |
| 435 | ALVLPSIVILDLLQL | 22 |
| 20 | NGINGIKDARKVTVG | 21 |
| 117 | SNNMRINQYPESNAE | 21 |
| 161 | ASRQVYICSNNIQAR | 21 |
| 174 | ARQQVIELARQLNFI | 21 |
| 277 | AAAYQLYYGTKYRRF | 21 |
| 373 | LLAVTSIPSVSNALN | 21 |
| 399 | GYVALLISTFHVLIY | 21 |
| 407 | TFHVLIYGWKRAFEE | 21 |
| 31 | VTVGVIGSGDFAKSL | 20 |
| 142 | IVKGFNVVSAWALQL | 20 |
| 209 | FTLWRGPVVVAISLA | 20 |
| 346 | ENSWNEEEVWRIEMY | 20 |
| 385 | ALNWREFSFIQSTLG | 20 |
| 429 | PPNFVLALVLPSIVI | 20 |
| 45 | LTIRLIRCGYHVVIG | 19 |
| 80 | EDALTKTNIIFVAIH | 19 |
| 95 | REHYTSLWDLRHLLV | 19 |
| 135 | SLFPDSLIVKGFNVV | 19 |
| 139 | DSLIVKGFNVVSAWA | 19 |
| 224 | TFFFLYSFVRDVIHP | 19 |
| 259 | LPIVAITLLSLVYLA | 19 |
| 280 | YQLYYGTKYRRFPPW | 19 |
| 281 | QLYYGTKYRRFPPWL | 19 |
| 288 | YRRFPPWLETWLQCR | 19 |
| 307 | LLSFFFAMVHVAYSL | 19 |
| 322 | CLPMRRSERYLFLNM | 19 |
| 328 | SERYLFLNMAYQQVH | 19 |
| 357 | IEMYISGFIMSLGLL | 19 |
| 400 | YVALLISTFHVLIYG | 19 |
| 424 | YRFYTPPNFVLALVL | 19 |
| 7 | MGSPKSLSETCLPNG | 18 |

TABLE XLVI-continued

V1-HLA-DRB1-0101-15mers-98P4B6

Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 25 | IKDARKVTVGVIVSG | 18 |
| 27 | DARKVTVGVIGSGDF | 18 |
| 39 | GDFAKSLTIRLIRCG | 18 |
| 47 | IRLIRCGYHVVIGSR | 18 |
| 62 | NPKFASEFFPHVVDV | 18 |
| 129 | NAEYLASLFPDSLIV | 18 |
| 163 | RQYVICSNNIQARQQ | 18 |
| 167 | ICSNNIQARQQVIEL | 18 |
| 179 | IELARQLNFIPIDLG | 18 |
| 190 | IDLGSLSSAREIENL | 18 |
| 236 | IHPYARNQQSDFYKI | 18 |
| 267 | LSLVYLAGLLAAAYQ | 18 |
| 268 | SLVYLAGLLAAAYQL | 18 |
| 285 | GTKYRRFPPWLETWL | 18 |
| 296 | ETWLQCRKQLGLLSF | 18 |
| 299 | LQCRKQLGLLSFFFA | 18 |
| 326 | RRSERYLFLNMAYQQ | 18 |
| 380 | PSVSNALNWERFSFI | 18 |
| 383 | SNALNWREFSFIQST | 18 |
| 390 | EFSFIQSTLGYVALL | 18 |
| 405 | ISTFHVLIYGWKRAF | 18 |
| 410 | VLIYGWKRAFEEEYY | 18 |
| 423 | YYRFYTPPNFVLALV | 18 |
| 433 | VLALVLPSIVILDLL | 18 |
| 22 | INGIKDARKVTVGVI | 17 |
| 29 | RKVTVGVIGSGDFAK | 17 |
| 33 | VGVIGSGDFAKSLTI | 17 |
| 34 | GVIGSGDFAKSLTIR | 17 |
| 44 | SLTIRLIRCGYHVVI | 17 |
| 46 | TIRLIRCGYHVVIGS | 17 |
| 46 | TIRLIRCGYHVVIGS | 17 |
| 54 | YHVVIGSRNPKFASE | 17 |
| 58 | IGSRNPKFASEFFPG | 17 |
| 77 | THHEDALTKTNIIFV | 17 |
| 87 | NIIFVAIHREHYTSL | 17 |
| 90 | FVAIHREHYTSLWDL | 17 |
| 105 | RHLLVGKILIDVSNN | 17 |
| 119 | NMRINQYPESNAEYL | 17 |
| 138 | PDSLIVKGFNVVSAW | 17 |
| 140 | SLIVKGFNVVSAWAL | 17 |
| 151 | AWALQLGPKDASRQV | 17 |
| 154 | LQLGPKDASRQVYIC | 17 |
| 176 | QQVIELARQLNFIPI | 17 |
| 187 | FIPIDLGSLSSAREI | 17 |
| 195 | LSSAREIENLPLRLF | 17 |
| 217 | VVAISLATFFFLYSF | 17 |
| 226 | FFLYSFVRDVIHPYA | 17 |
| 232 | VRDVIHPYARNQQSD | 17 |
| 251 | PIEIVNKTLPIVAIT | 17 |
| 253 | EIVNKTLPIVAITLL | 17 |
| 270 | VYLAGLLAAAYQLYY | 17 |
| 271 | YLAGLLAAAYQLYYG | 17 |
| 305 | LGLLSFFFAMVHVAY | 17 |
| 316 | HVAYSLVLPMRRSER | 17 |
| 317 | VAYSLCLPMRRSERY | 17 |
| 329 | ERYLFLNMAYQQVHA | 17 |
| 361 | ISFGIMSLGLLSLLA | 17 |
| 363 | FGIMSLGLLSLLAVT | 17 |
| 389 | REFSFIQSTLGYVAL | 17 |
| 392 | SFIQSTLGYVALLIS | 17 |
| 406 | STFHVLIYGWKRAFE | 17 |
| 408 | FHVLIYGWKRAFEEE | 17 |
| 436 | LVLPSIVILDLLQLC | 17 |
| 2 | ESISMMGSPKSLSET | 16 |
| 3 | SISMMGSPKSLSETC | 16 |
| 8 | GSPKSLSETCLPNGI | 16 |
| 11 | KSLSETCLPNGINGI | 16 |
| 16 | TCLPNGINGIKDARK | 16 |
| 24 | GIKDARKVTVGVIGS | 16 |
| 59 | GSRNPKFASEFFPHV | 16 |

TABLE XLVI-continued

V1-HLA-DRB1-0101-15mers-98P4B6

Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 67 | SEFFPHVVDVTHHED | 16 |
| 71 | PHVVDVTHHEDALTK | 16 |
| 103 | DLRHLLVGKILIDVS | 16 |
| 111 | KILIDVSNNMRINQY | 16 |
| 126 | PESNAEYLASLGPDS | 16 |
| 153 | ALQLGPKDASRQVYI | 16 |
| 166 | YICSNNIQARQQVIE | 16 |
| 171 | NIQARQQVIELARQL | 16 |
| 175 | RQQVIELARQLNFIP | 16 |
| 182 | ARQLNFIPIDLGSLS | 16 |
| 200 | EIENLPLRLFTLWRG | 16 |
| 208 | LFTLWRGPVVVAISL | 16 |
| 219 | AISLATFFFLYSFVR | 16 |
| 225 | FFFLYSFVRDVIHPY | 16 |
| 263 | AITLLSLVYLAGLLA | 16 |
| 265 | TLLSLVYLAGLLAAA | 16 |
| 294 | WLETWLQCRKQLGLL | 16 |
| 304 | QLGLLSFFFAMVHVA | 16 |
| 308 | LSFFFAMVHVAYSLC | 16 |
| 310 | FFFAMVHVAYSLCLP | 16 |
| 314 | MVHVAYSLCLPMRRS | 16 |
| 371 | LSLLAVTSIPSVSNA | 16 |
| 394 | IQSTLGYVALLISTF | 16 |
| 401 | VALLISTFHVLIYGW | 16 |
| 420 | EEEYYRFYTPPNFVL | 16 |
| 428 | TPPNFVLALVLPSIV | 16 |
| 440 | SIVILDLLQLCRYPD | 16 |

TABLE XLVI

V2-HLA-DRB1-0101-15mers-98P4B6

Each peptide is a portion of SEQ ID NO: 5, each start position is specified, the length of peptide is 15 amino acids, and the end position for each peptide is the start position plus fourteen.

| Pos | 123456789012345 | score |
|---|---|---|
| 17 | FTPFSCLSLPSSWDY | 26 |
| 28 | SWDYRCPPPCPADFF | 26 |

TABLE XLVI-continued

V2-HLA-DRB1-0101-15mers-98P4B6

Each peptide is a portion of SEQ ID NO: 5, each start position is specified, the length of peptide is 15 amino acids, and the end position for each peptide is the start position plus fourteen.

| Pos | 123456789012345 | score |
|---|---|---|
| 6 | LQALSLSLSSGFTPF | 25 |
| 8 | ALSLSLSSGFTPFSC | 25 |
| 3 | SPGLQALSLSLSSGF | 24 |
| 10 | SLSLSSGFTPFSCLS | 22 |
| 14 | SSGFTPFSCLSLPSS | 19 |
| 26 | PSSWDYRCPPPCPAD | 16 |
| 31 | YRCPPPCPADFFLYF | 16 |
| 1 | SGSPGLQALSLSLSS | 15 |
| 4 | PGLQALSLSLSSGFT | 15 |
| 20 | FSCLSLPSSWDYRCP | 15 |
| 2 | GSPGLQALSLSLSSG | 14 |
| 7 | QALSLSLSSGFTPFS | 14 |
| 13 | LSSGFTPFSCLSLPS | 14 |
| 16 | GFTPFSCLSLPSSWD | 14 |
| 19 | PFSGLSLPSSWDYRC | 14 |
| 27 | SSWDYRCPPPCPADF | 14 |
| 30 | DYRCPPPCPADFFLY | 14 |

TABLE XLVI

V5A-HLA-DRB1-0101-15mers-98P4B6

Each peptide is a portion of SEQ ID NO: 11; each start position is specified, the length of peptide is 15 amino acids, and the end position for each peptide is the start position plus fourteen.

| Pos | 123456789012345 | score |
|---|---|---|
| 11 | LRLFTFWRPGVVVAI | 28 |
| 3 | AREIENLPLRLFTFW | 25 |
| 16 | FWRGPVVVAISLATF | 22 |
| 14 | FTFWRGPVVVAISLA | 20 |
| 13 | LFTFWRGPVVVAISL | 18 |
| 5 | EIENLPLRLFTFWRG | 16 |
| 10 | PLRLFTFWRGPVVVA | 16 |
| 12 | RLFTFWRGPVVVAIS | 15 |
| 2 | SAREIENLPLRLFTF | 14 |

TABLE XLVI-continued

V5A-HLA-DRB1-0101-15mers-98P4B6

Each peptide is a portion of SEQ ID NO: 11; each start position is specified, the length of peptide is 15 amino acids, and the end position for each peptide is the start position plus fourteen.

| Pos | 123456789012345 | score |
|---|---|---|
| 7 | ENLPLRLFTFWRGPV | 14 |
| 15 | TFWRGPVVVAISLAT | 14 |

TABLE XLVI

V5B-HLA-DRB1-0101-15mers-98P4B6

Each peptide is a portion of SEQ ID NO: 11; each start position is specified, the length of peptide is 15 amino acids, and the end position for each peptide is the start position plus fourteen.

| Pos | 123456789012345 | score |
|---|---|---|
| 7 | WREFSFIQIFCSFAD | 25 |
| 9 | EFSFIQIFCSFADTQ | 24 |
| 4 | ALNWREFSFIQIFCS | 20 |
| 2 | SNALNWREFSFIQLF | 18 |
| 20 | ADTQTELELEFVFLL | 18 |
| 8 | REFSFIQIFCSFADT | 17 |
| 10 | FSFIQIFCSFADTQT | 17 |
| 22 | TQTELELEFVFLLTL | 17 |
| 23 | QTELELEFVFLLTLL | 17 |
| 12 | FIQIFCSFADTQTEL | 16 |
| 16 | FCSFADTQTELELEF | 16 |
| 17 | GSFADTQTELELEFV | 14 |

TABLE XLVI

V6-HLA-DRB1-0101-15mers-98P4B6

Each peptide is a portion of SEQ ID NO: 13; each start position is specified, the length of peptide is 15 amino acids, and the end position for each peptide is the start position plus fourteen.

| Pos | 123456789012345 | score |
|---|---|---|
| 1 | NFVLALVLPSIVILG | 29 |
| 8 | LPSIVILGKJILFLP | 29 |
| 46 | GGTLPHVSPERVTVM | 28 |
| 17 | IILFLPCISRKLKRI | 26 |
| 11 | IVILGKIILFLPCIS | 24 |
| 38 | SQFLEEGIGGTIPHV | 24 |
| 39 | QFLEEGIGGTIPHVS | 24 |

TABLE XLVI-continued

V6-HLA-DRB1-0101-15mers-98P4B6

Each peptide is a portion of SEQ ID NO: 13; each start position is specified, the length of peptide is 15 amino acids, and the end position for each peptide is the start position plus fourteen.

| Pos | 123456789012345 | score |
|---|---|---|
| 7 | VLPSIVILGKIILFL | 23 |
| 14 | LGKIILFLPCISRKL | 23 |
| 2 | FVLALVLPSIVILGK | 22 |
| 42 | EEGIGGTIPHVSPER | 22 |
| 13 | ILGKIILFLPCISRK | 19 |
| 3 | VLALVLPSIVILGKI | 18 |
| 6 | LVLPSIVILGKIILF | 18 |
| 9 | PSIVILGKIILFLPC | 17 |
| 15 | GKIILFLPCISRKLK | 17 |
| 5 | ALVLPSIVILGKIIL | 16 |
| 10 | SIVILGKIILFLPCI | 16 |
| 18 | ILFLPCISRKLKRIK | 15 |
| 25 | SRKLKRIKKGWEKSQ | 15 |
| 30 | RIKKGWEKSQFLEEG | 14 |
| 43 | EGIGGTIPHVSPERV | 14 |

TABLE XLVI

V7A-HLA-DRB1-0101-15mers-98P4B6

Each peptide is a portion of SEQ ID NO: 15; each start position is specified, the length of peptide is 15 amino acids, and the end position for each peptide is the start position plus fourteen.

| Pos | 123456789012345 | score |
|---|---|---|
| 12 | SETFLPNGINGIKDA | 21 |
| 5 | MGSPKSLSETFLPNG | 18 |
| 1 | SISMMGSPKSLSETF | 16 |
| 4 | MMGSPKSLSETFLPN | 16 |
| 6 | GSPKSLSETFLPNGI | 16 |
| 9 | KSLSETFLPNGINGI | 16 |
| 14 | TFLPNGINGIKDARK | 16 |
| 2 | ISMMGSPKSLSETFL | 14 |
| 15 | FLPNGINGIKDARKV | 13 |
| 10 | SLSETFLPNGINGIK | 10 |

TABLE XLVI

V7B-HLA-DRB1-0101-15mers-98P4B6

Each peptide is a portion of SEQ ID NO: 15; each start position is specified, the length of peptide is 15 amino acids, and the end position for each peptide is the start position plus fourteen.

| Pos | 123456789012345 | score |
|---|---|---|
| 4 | RYLFLNMAYQQSTLG | 24 |
| 14 | QSTLGYVALLISTFH | 22 |
| 7 | FLNMAYQQSTLGYVA | 21 |
| 2 | SERYLFLNMAYQQST | 19 |
| 9 | NMAYQQSTLGYVALL | 18 |
| 3 | ERYLFLNMAYQQSTL | 17 |
| 11 | AYQQSTLGYVALLIS | 17 |
| 10 | MAYQQSTLGYVALLI | 16 |
| 13 | QQSTLGYVALLISTF | 16 |
| 8 | LNMAYQQSTLGYVAL | 14 |

TABLE XLVI

V7C-HLA-DRB1-0101-15mers-98P4B6

Each peptide is a portion of SEQ ID NO: 15; each start position is specified, the length of peptide is 15 amino acids, and the end position for each peptide is the start position plus fourteen.

| Pos | 123456789012345 | score |
|---|---|---|
| 23 | AAAWKCLGANILRGG | 36 |
| 168 | SGTWMKLETIILSKL | 35 |
| 138 | EFLLRLLKSQAASGT | 33 |
| 13 | DLSVEVLASPAAAWK | 30 |
| 50 | DRKIPPLSTPPPPAM | 30 |
| 28 | CLGANILRGGLSEIV | 28 |
| 62 | PAMWTEEAGATAWAQ | 27 |
| 110 | ESPDRALKAANSWRN | 26 |
| 124 | NPVLPHTNGVGPLWE | 26 |
| 141 | LRLLKSQAASGTLSL | 25 |
| 8 | SIVILDLSVEVLASP | 24 |
| 31 | ANILRGGLSEIVLPI | 24 |
| 42 | VLPIEWQQDRKIPPL | 24 |
| 77 | ESGIRNKSSSSSQIP | 24 |
| 130 | TNGVGPLWEFLLRLL | 24 |
| 137 | WEFLLRLLKSQAASG | 24 |
| 7 | PSIVILDLSVEVLAS | 23 |
| 12 | LDLSVEVLASPAAAW | 23 |
| 150 | SGTLSLAFTSWSLGE | 23 |

TABLE XLVI-continued

V7C-HLA-DRB1-0101-15mers-98P4B6

Each peptide is a portion of SEQ ID NO: 15; each start position is specified, the length of peptide is 15 amino acids, and the end position for each peptide is the start position plus fourteen.

| Pos | 123456789012345 | score |
|---|---|---|
| 171 | WMKLETIILSKLTQE | 23 |
| 3 | ALVLPSIVILDLSVE | 22 |
| 53 | IPPSLTPPPPAMWTE | 22 |
| 157 | FTSWSLGEFLGSGTW | 22 |
| 89 | QIPVVGVVTEDDEAQ | 21 |
| 6 | LPSIVILDLSVEVLA | 20 |
| 58 | TPPPPAMWTEEAGAT | 20 |
| 97 | TEDDEAQDSIDPPES | 20 |
| 100 | DEAQDSIDPPESPDR | 20 |
| 134 | GLPWEFLLRLLKSQA | 19 |
| 154 | SLAFTSWSLGEFLGS | 19 |
| 1 | VLALVLPSIVILDLS | 18 |
| 22 | PAAAWKCLGANILRG | 18 |
| 44 | PIEWQQDRKIPPLST | 18 |
| 122 | WRNPBLPHTNGVGPL | 18 |
| 135 | PLWEFLLRLLKSQAA | 18 |
| 140 | LLRLLKSQAASGTLS | 18 |
| 148 | AASGTLSLAFTSWSL | 18 |
| 159 | SWSLGEFLGSGTWMK | 18 |
| 161 | SLGEFLGSGTWNKLE | 18 |
| 169 | GTWMKLETIILSKLT | 18 |
| 176 | TIILSKLTQEQKSKH | 18 |
| 4 | LVLPSIVILDLSVEV | 17 |
| 9 | IVILDLSVEVLASPA | 17 |
| 30 | GANILRGGLSEIVLP | 17 |
| 61 | PPAMWTEEAGATAEA | 17 |
| 67 | EEAGATAEAQESGIR | 17 |
| 94 | GVVTEDDEAQDSIDP | 17 |
| 101 | EAQDSIDPPESPDRA | 17 |
| 107 | DPPESPDRALKAANS | 17 |
| 133 | VGPLWEFLLRLLKSQ | 17 |
| 143 | LLKSQAASGTLSLAF | 17 |
| 162 | LGEFLGSGTQMKLET | 17 |

TABLE XLVI-continued

V7C-HLA-DRB1-0101-15mers-98P4B6

Each peptide is a portion of SEQ ID NO: 15; each start position is specified, the length of peptide is 15 amino acids, and the end position for each peptide is the start position plus fourteen.

| Pos | 123456789012345 | score |
|---|---|---|
| 163 | GEFLGSGTWMKLETI | 17 |
| 172 | MKLETIILSKLTQEQ | 17 |

TABLE XLVI

V8-HLA-DRB1-0101-15mers-98P4B6

Each peptide is a portion of SEQ ID NO: 17; each start position is specified, the length of peptide is 15 amino acids, and the end position for each peptide is the start position plus fourteen.

| Pos | 123456789012345 | score |
|---|---|---|
| 8 | SQFLEEGMGGTIPHV | 24 |
| 9 | QFLEEGMGGTIPHVS | 24 |
| 12 | EEGMGGTIPHVSPER | 22 |
| 13 | EGMGGTIPHVSPERV | 14 |
| 7 | KSQFLEEGMGGTIPH | 13 |
| 2 | KKGWEKSQFLEEGMG | 12 |
| 6 | EKSQFLEEGMGGTIP | 12 |

TABLE XLVI

V13-HLA-DRB1-0101-15mers-98P4B6

Each peptide is a portion of SEQ ID NO: 27; each start position is specified, the length of peptide is 15 amino acids, and the end position for each peptide is the start position plus fourteen.

| Pos | 123456789012345 | score |
|---|---|---|
| 12 | SETFLPNGINGIKDA | 21 |
| 5 | MGSPKSLSETFLPNG | 18 |
| 1 | SISMMGSPKSLSETF | 16 |
| 4 | MMGSPKSLSETFLPN | 16 |
| 6 | GSPKSLSETFLPNGI | 16 |
| 9 | KSLSETFLPNGINGI | 16 |
| 14 | TFLPNGINGIKDARK | 16 |
| 2 | ISMMGSPKSLSETFL | 14 |
| 15 | FLPNGINGIKDARKV | 13 |
| 10 | SLSETFLPNGINGIK | 10 |

TABLE XLVI

V14-HLA-DRB1-0101-15mers-98P4B6

Each peptide is a portion of SEQ ID NO: 29; each start position is specified, the length of peptide is 15 amino acids, and the end position for each peptide is the start position plus fourteen.

| Pos | 123456789012345 | score |
|---|---|---|
| 10 | LRLFTFWRGPVVVAI | 28 |
| 2 | AREIENLPLRLFTFW | 25 |
| 15 | FWRGPVVVAISLATF | 22 |
| 13 | FTFWRGPVVVAISLA | 20 |
| 12 | LFTFWRGPVVVAISL | 18 |
| 4 | EIENLPLRLFTFWRG | 16 |
| 9 | PLRLFTFWRGPVVVA | 16 |
| 11 | RLFTFWRGPVVVAIS | 15 |
| 1 | SAREIENLPLRLFTF | 14 |
| 6 | ENLPLRLFTFWRGPV | 14 |
| 14 | TFWRGPVVVAISLAT | 14 |
| 8 | LPLRLFTFWRGPVVV | 12 |

TABLE XLVI

V21-HLA-DRB1-0101-15mers-98P4B6

Each peptide is a portion of SEQ ID NO: 43; each start position is specified, the length of peptide is 15 amino acids, and the end position for each peptide is the start position plus fourteen.

| Pos | 123456789012345 | score |
|---|---|---|
| 3 | TIILSKLTQEQKTKH | 18 |
| 2 | ETIILSKLTQEQKTK | 14 |
| 7 | SKLTQEQKTKHCMFS | 13 |
| 6 | LSKLTQEQKTKHCMF | 11 |
| 11 | QEQKTKHCMFSLISG | 11 |
| 1 | LETIILSKLTQEQKT | 10 |
| 9 | LTQEQKTKHCMFSLI | 10 |
| 10 | TQEQKTKHCMFSLIS | 9 |
| 12 | EQKTKHCMFSLISGS | 9 |
| 5 | ILSKLTQEQKTKHCM | 8 |
| 8 | KLTQEQKTKHCMFSL | 8 |

TABLE XLVI

V25-HLA-DRB1-0101-15mers-98P4B6

Each peptide is a portion of SEQ ID NO: 51; each start position is specified, the length of peptide is 15 amino acids, and the end position for each peptide is the start position plus fourteen.

| Pos | 123456789012345 | score |
|---|---|---|
| 6 | IILFLPCISQKLKRI | 25 |
| 3 | LGKIILFLPCISQKL | 23 |
| 2 | ILGKIILFLPCISQK | 19 |
| 4 | GKIILFLPCISQKLK | 17 |
| 7 | ILFLPCISQKLKRIK | 15 |
| 9 | FLPCISQKLKRIKKG | 15 |
| 14 | SQKLKRIKKGWEKSQ | 15 |
| 15 | QKLKRIKKGWEKSQF | 13 |

TABLE XLVII

V1-HLA-DRB1-0301-15mers-98P4B6

Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 97 | HYTSLWDLRHLLVGK | 28 |
| 176 | QQVIELARQLNFIPI | 27 |
| 228 | LYSFVRDVIHPYARN | 27 |
| 322 | CLPMRRSERYLFLNM | 27 |
| 54 | YHVVIGSRNPKFASE | 26 |
| 296 | ETWLQCRKQLGLLSF | 26 |
| 408 | FHVLITGWKRAFEEE | 26 |
| 273 | AGLLAAAYQLYYGTK | 25 |
| 439 | PSIVILDLLQLCRYP | 25 |
| 109 | VGKILIDVSNNMRIN | 24 |
| 288 | YRRFPPWLETWLQCR | 24 |
| 87 | NIIFVAIHREHYTSL | 23 |
| 423 | YYRFYTPPNFVLALV | 23 |
| 133 | LASLFPDSLIVKGFN | 22 |
| 185 | LNFIPIDLGSLSSAR | 22 |
| 261 | IVAITLLSLVYLAGL | 22 |
| 272 | LAGLLAAAYQLYYGT | 22 |
| 433 | VLALVLPSIVILDLL | 22 |
| 145 | GFNVVSAWALQLGPK | 21 |
| 214 | GPVVVAISLATFFFL | 21 |

TABLE XLVII-continued

V1-HLA-DRB1-0301-15mers-98P4B6

Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 269 | LVYLAGLLAAAYQLY | 21 |
| 362 | SFGIMSLGLLSLLAV | 21 |
| 363 | FGIMSLGLLSLLAVT | 21 |
| 175 | RQQVIELARQLNFIP | 20 |
| 198 | AREIENLPLRLFTLW | 20 |
| 258 | TLPIVAITLLSLVYL | 20 |
| 264 | ITLLSLVYLAGLLAA | 20 |
| 376 | VTSIPSVSNALNWRE | 20 |
| 400 | YVALLISTFHVLIYG | 20 |
| 435 | ALVLPSIVILDLLQL | 20 |
| 438 | LPSIVILDLLQLCRY | 20 |
| 440 | SIVILDLLQLCRYPD | 20 |
| 30 | KVTVGVIGSGDFAKS | 19 |
| 53 | GYHVVIGSFNPKFAS | 19 |
| 110 | GKILIDVSNNMRINQ | 19 |
| 130 | AEYLASLFPDSLIVK | 19 |
| 151 | AWALQLGPKDASRQV | 19 |
| 215 | PVVVAISLATFFFLY | 19 |
| 217 | VVAISLATFFFLYSF | 19 |
| 256 | NKTLPIVAITLLSLV | 19 |
| 312 | FAMVHVAYSLVLPMR | 19 |
| 320 | SLCLPMRRSERYLFL | 19 |
| 402 | ALLISTFHVLIYGWK | 19 |
| 3 | SISMMGSPKSLSETC | 18 |
| 22 | INGIKDARKVTVGVI | 18 |
| 34 | GVIGSGDFAKSLTIR | 18 |
| 90 | FVAIHREHYTSLWDL | 18 |
| 119 | NMRINQYPESNAEYL | 18 |
| 139 | DSLIVKGFNVVSAWA | 18 |
| 143 | VKGFNVVSAWALQLG | 18 |
| 162 | SRQVYICSNNIQARQ | 18 |
| 184 | QLNFIPIFLGSLSSA | 18 |
| 195 | LSSAREIENLPLRLF | 18 |
| 233 | RDVIHOYARNQQSDF | 18 |
| 308 | LSFFFAMVHVAYSLC | 18 |

TABLE XLVII-continued

V1-HLA-DRB1-0301-15mers-98P4B6

Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 331 | YLFLNMAYQQVHANI | 18 |
| 360 | YISFGIMSLGLLSLL | 18 |
| 409 | HVLIYGWKRAFEEEY | 18 |
| 7 | MGSPKSLSETCLPNG | 17 |
| 21 | GINGIKDARKVTVGV | 17 |
| 38 | SGDFAKSLTIRLIRC | 17 |
| 113 | LIDVSNNMRINQYPE | 17 |
| 121 | RINQYPESNAEYLAS | 17 |
| 155 | QLGPKDASRQVYICS | 17 |
| 169 | SNNIQARQQVIELAR | 17 |
| 178 | VIELARQLNFIPIDL | 17 |
| 192 | LGSLSSAREIENLPL | 17 |
| 225 | FFFLYSFVRDVIHPY | 17 |
| 249 | KIPIEIVNKTLPIVA | 17 |
| 292 | PPWLETWLQCRKQLG | 17 |
| 318 | AYSLCLPMRRSERYL | 17 |
| 327 | RSERYLFLNMATQQV | 17 |
| 338 | YQQHVANIENSWNEE | 17 |
| 379 | IPSVSNALNWREFSF | 17 |
| 416 | KRAFEEEYYRFYTPP | 17 |
| 15 | ETCLPNGINGIKDAR | 16 |
| 72 | HVVDVTHHEDALTKT | 16 |
| 79 | HEDALTKTNIIFVAI | 16 |
| 88 | IIFVAIHREHYTSLW | 16 |
| 111 | KILIDVSNNMRINQY | 16 |
| 205 | PLRLFTLWRGPVVVA | 16 |
| 248 | YKIPIEIVNKTLPIV | 16 |
| 279 | AYQLYYGTKYRRFPP | 16 |
| 342 | HANIENSWNEEEVWR | 16 |
| 382 | VSNALNWREFSFIQS | 16 |
| 413 | YGWKRAFEEEYYRFY | 16 |
| 43 | KSLTIRLIRCGYHVV | 15 |
| 263 | AITLLSLVYLAGLLA | 15 |
| 294 | WLETWLQCRKQLGLL | 15 |
| 321 | LCLPMRRSERYLFLN | 15 |

TABLE XLVII-continued

V1-HLA-DRB1-0301-15mers-98P4B6

Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 367 | SLGLLSLLAVTSIPS | 15 |
| 387 | NWREFSFIQSTLGYV | 15 |
| 412 | IYGWKRAFEEEYYRF | 15 |
| 73 | VVDVTHHEDALTKTN | 14 |
| 104 | LRHLLVGKILIDVSN | 14 |
| 236 | IHPYARNQQSDFYKI | 14 |
| 267 | LSLVYLAGLLAAAYQ | 14 |
| 304 | QLGLLSFFFAMVHVA | 14 |
| 365 | IMSLGLLSLLAVTSI | 14 |
| 373 | LLAVTSIPSVSNALN | 14 |
| 401 | VALLISTFHVLIYGW | 14 |
| 434 | LALVLPSIVILDLLQ | 14 |
| 1 | MESISMMGSPKSLSE | 13 |
| 4 | ISMMGSPKSLSETCL | 13 |
| 32 | TVGVIGSGDFAKSLT | 13 |
| 33 | VGVIGSGDFAKSLTI | 13 |
| 101 | LWDLRHLLVGKILID | 13 |
| 138 | PDSLIVKGFNVVSAW | 13 |
| 164 | QVYICSNNIQARQQV | 13 |
| 189 | PIDLGSLSSAREIEN | 13 |
| 201 | IENLPLRLFTLWRGP | 13 |
| 213 | RGPVVVAISLATFFF | 13 |
| 266 | LLSLVYLAGLLAAAY | 13 |
| 407 | TFHVLITGWKRAFEE | 13 |

TABLE XLVII

V2-HLA-DR1-0301-15mers-98P4B6

Each peptide is a portion of SEQ ID NO: 5; each start position is specified, the length of peptide is 15 amino acids, and the end position for each peptide is the start position plus fourteen.

| Pos | 123456789012345 | score |
|---|---|---|
| 6 | LQALSLSLSSGFTPF | 20 |
| 14 | SSGFTPFSCLSLPSS | 20 |
| 20 | FSCLSLPSSWDYRCP | 20 |
| 24 | SLPSSWDYRCPPPCP | 16 |

TABLE XLVII-continued

V2-HLA-DR1-0301-15mers-98P4B6

Each peptide is a portion of SEQ ID NO: 5; each start position is specified, the length of peptide is 15 amino acids, and the end position for each peptide is the start position plus fourteen.

| Pos | 123456789012345 | score |
|---|---|---|
| 2 | GSPGLQALSLSLSSG | 12 |
| 3 | SPGLQALSLSLSSGF | 12 |
| 8 | ALSLSLSSGFTPFSC | 12 |
| 9 | LSLSLSSGFTPFSCL | 12 |
| 10 | SLSLSSGFTPFSCLS | 11 |
| 22 | CLSLPSSWDYRCPPP | 11 |
| 30 | DYRCPPPCPADFFLY | 10 |
| 31 | YRCPPPCPADFFLYF | 10 |
| 12 | SLSSGFTPFSCLSLP | 9 |
| 17 | FTPFSCLSLPSSWDY | 9 |

TABLE XLVII

V5A-HLA-DR1-0301-15mers-98P4B6

Each peptide is a portion of SEQ ID NO: 11; each start position is specified, the length of peptide is 15 amino acids, and the end position for each peptide is the start position plus fourteen.

| Pos | 123456789012345 | score |
|---|---|---|
| 3 | AREIENLPLRLFTFW | 20 |
| 10 | PLRLFTFWRGPVVVA | 16 |
| 2 | SAREIENLPLRLFTF | 12 |
| 6 | IENLPLRLFTFWRGP | 12 |
| 8 | NLPLRLFTFWRGPVV | 12 |
| 5 | EIENLPLRLFTFWRG | 11 |
| 13 | LFTFWRGPVVVAISL | 10 |
| 4 | REIENLPLRLFTFWR | 9 |
| 11 | LRLFTFWRGPVVVAI | 9 |

TABLE XLVII

V5B-HLA-DR1-0301-15mers-98P4B6

Each peptide is a portion of SEQ ID NO: 11; each start position is specified, the length of peptide is 15 amino acids, and the end position for each peptide is the start position plus fourteen.

| Pos | 123456789012345 | score |
|---|---|---|
| 15 | IFCSFADTQTELELE | 24 |
| 23 | QTELELEFVFLLTLL | 20 |
| 1 | VSNALNWREFSFIQI | 16 |

TABLE XLVII-continued

V5B-HLA-DR1-0301-15mers-98P4B6

Each peptide is a portion of SEQ ID NO: 11; each start position is specified, the length of peptide is 15 amino acids, and the end position for each peptide is the start position plus fourteen.

| Pos | 123456789012345 | score |
|---|---|---|
| 19 | FADTQTELELEFVFL | 16 |
| 21 | DTQTELELEFVFLLT | 16 |
| 17 | CSFADTQTELELEFV | 15 |
| 22 | TQTELELEFVFLLTL | 13 |
| 2 | SNALNWREFSFIQIF | 11 |
| 10 | FSFIQIFCSFADTQT | 11 |

TABLE XLVII

V6-HLA-DR1-0301-15mers-98P4B6

Each peptide is a portion of SEQ ID No: 13; each start position is specified, the length of peptide is 15 amino acids, and the end position for each peptide is the start position plus fourteen.

| Pos | 123456789012345 | score |
|---|---|---|
| 8 | LPSIVILGKIILFLP | 26 |
| 3 | VLALVLPSIVILGKI | 22 |
| 9 | PSIVILGKIILFLPC | 22 |
| 10 | SIVILGKIILFLPCI | 21 |
| 17 | IILFLPCISRKLKRI | 20 |
| 18 | ILFLPCISRKLKRIK | 18 |
| 25 | SRKLKRIKKGWEKSQ | 18 |
| 21 | LPCISRKLKRIKKGW | 17 |
| 28 | LKRIKKGWEKSQFLE | 17 |
| 29 | KRIKKGWEKSQFLEE | 16 |
| 4 | LALVLPSIVILGKII | 14 |
| 14 | LGKIILFLPCISRKL | 13 |
| 15 | GKIILFLPCISRKLK | 13 |
| 1 | NFVLALVLPSIVILG | 12 |
| 5 | ALVLPSIVILGKIIL | 12 |
| 37 | KSQFLEEGIGGTIPH | 12 |

TABLE XLVII

V7A-HLA-DR1-0301-15mers-98P4B6

Each peptide is a portion of SEQ ID NO: 15; each start position is specified, the length of peptide is 15 amino acids, and the end position for each peptide is the start position plus fourteen.

| Pos | 123456789012345 | score |
|---|---|---|
| 1 | SISMMGSPKSLSETF | 18 |
| 5 | MGSPKSLSETFLPNG | 17 |
| 13 | ETFLPNGINGIKDAR | 16 |
| 2 | ISMMGSPKSLSETFL | 13 |
| 12 | SETFLPNGINGIKDA | 13 |
| 8 | PKSLSETFLPNGING | 12 |
| 4 | MMGSPKSLSETFLPN | 9 |
| 10 | SLSETFLPNGINGIK | 8 |

TABLE XLVII

V7B-HLA-DR1-0301-15mers-98P4B6

Each peptide is a portion of SEQ ID NO: 15; each start position is specified, the length of peptide is 15 amino acids, and the end position for each peptide is the start position plus fourteen.

| Pos | 123456789012345 | score |
|---|---|---|
| 5 | YLFLNMAYQQSTLGY | 18 |
| 1 | RSERYLFLNMAYQQS | 17 |
| 6 | LFLNMAYQQSTLGYV | 14 |
| 12 | YQQSTLGYVALLIST | 12 |
| 3 | ERYLFLNMAYQQSTL | 11 |
| 4 | RYLFLNMAYQQSTLG | 11 |
| 7 | FLNMAYQQSTLGYVA | 11 |
| 11 | AYQQSTLGYVALLIS | 11 |
| 14 | QSTLGYVALLISTFH | 11 |
| 8 | LNMAYQQSTLGYVAL | 10 |

TABLE XLVII

V7C-HLA-DR1-0301-15mers-98P4B6

Each peptide is a portion of SEQ ID NO: 15; each start position is specified, the length of peptide is 15 amino acids, and the end position for each peptide is the start position plus fourteen.

| Pos | 123456789012345 | score |
|---|---|---|
| 93 | VGVVTEDDEAQDSID | 29 |
| 130 | TNGVGPLWEFLLRLL | 26 |
| 7 | PSIVILDLSVEVLAS | 24 |
| 1 | VLALVLPSIVILDLS | 22 |
| 8 | SIVILDLSVEVLASP | 21 |
| 133 | VGPLWEFLLRLLKSQ | 21 |
| 3 | ALVLPSIVILDLSVE | 20 |
| 163 | GEFLGSGTWMKLETI | 20 |
| 9 | IVILDLSVEVLASPA | 19 |
| 123 | RNPVLPHTNGVGPLW | 19 |
| 137 | WEFLLRLLKSQAASG | 19 |
| 154 | SLAFTSWSLGEFLGS | 19 |
| 171 | WMKLETIILSKLTQE | 19 |
| 38 | LSEIVLPIEWQQDRK | 18 |
| 179 | LSKLTQEQKSKHCMF | 18 |
| 40 | EIVLPIEWQQDRKIP | 17 |
| 44 | PIEWQQDRKIPPLST | 16 |
| 90 | IPVVGVVTEDDEAQD | 16 |
| 176 | TIILSKLTQEQKSKH | 16 |
| 15 | SVEVLASPAAAWKCL | 15 |
| 27 | KCLGANILRGGLSEI | 15 |
| 32 | NILRGGLSEIVLPIE | 15 |
| 39 | SEIVLPIEWQQDRKI | 15 |
| 116 | LKAANSWRNPVLPHT | 15 |
| 138 | EFLLRLLKSQAASGT | 15 |
| 175 | ETIILSKLTQEQKSK | 15 |
| 2 | LALVLPSIVILDLSV | 14 |

TABLE XLVII

V8-HLA-DR1-0301-15mers-98P4B6

Each peptide is a portion of SEQ ID NO: 17; each start position is specified, the length of peptide is 15 amino acids, and the end position for each peptide is the start position plus fourteen.

| Pos | 123456789012345 | score |
|---|---|---|
| 7 | KSQFLEEGMGGTIPH | 12 |
| 8 | SQFLEEGMGGTIPHV | 11 |
| 12 | EEGMGGTIPHVSPER | 10 |
| 1 | TKKGWEKSQFLEEGM | 9 |
| 4 | GWEKSQFLEEGMGGT | 7 |
| 5 | WEKSQFLEEGMGGTI | 7 |

TABLE XLVII

V13-HLA-DR1-0301-15mers-98P4B6
Each peptide is a portion of SEQ ID NO: 27; each start position is specified, the length of peptide is 15 amino acids, and the end position for each peptide is the start position plus fourteen.

| Pos | 123456789012345 | score |
|---|---|---|
| 1 | SISMMGSPKSLSETF | 18 |
| 5 | MGSPKSLSETFLPNG | 17 |
| 13 | ETFLPNGINGIKDAR | 16 |
| 2 | ISMMGSPKSLSETFL | 13 |
| 12 | SETFLPNGINGIKDA | 13 |
| 8 | PKSLSETFLPNGING | 12 |
| 4 | MMGSPKSLSETFLPN | 9 |
| 10 | SLSETFLPNG1NGIK | 8 |

TABLE XLVII

V14-HLA-DR1-0301-15mers-98P4B6
Each peptide is a portion of SEQ ID NO: 29; each start position is specified, the length of peptide is 15 amino acids, and the end position for each peptide is the start position plus fourteen.

| Pos | 123456789012345 | score |
|---|---|---|
| 2 | AREIENLPLRLFTFW | 20 |
| 9 | PLRLFTFWRGPVVVA | 16 |
| 1 | SAREIENLPLRLFTF | 12 |
| 5 | IENLPLRLFTFWRGP | 12 |
| 7 | NLPLRLFTFWRGPVV | 12 |
| 4 | EIENLPLRLFTFWRG | 11 |
| 12 | LFTFWRGPVVVAISL | 10 |
| 3 | REIENLPLRLFTFWR | 9 |
| 10 | LRLFTFWRGPVVVAI | 9 |

TABLE XLVII

V21-HLA-DR1-0301-15mers-98P4B6
Each peptide is a portion of SEQ ID NO: 43; each start position is specified, the length of peptide is 15 amino acids, and the end position for each peptide is the start position plus fourteen.

| Pos | 123456789012345 | score |
|---|---|---|
| 6 | LSKLTQEQKTKHCMF | 18 |
| 3 | TIILSKLTQEQKTKH | 16 |
| 2 | ETIILSKLTQEQKTK | 15 |
| 1 | LETIILSKLTQEQKT | 13 |
| 4 | IILSKLTQEQKTKHC | 10 |
| 5 | ILSKLTQEQKTKHCM | 9 |

TABLE XLVII-continued

V21-HLA-DR1-0301-15mers-98P4B6
Each peptide is a portion of SEQ ID NO: 43; each start position is specified, the length of peptide is 15 amino acids, and the end position for each peptide is the start position plus fourteen.

| Pos | 123456789012345 | score |
|---|---|---|
| 9 | LTQEQKTKHCMFSLI | 9 |
| 11 | QEQKTKHCMFSLISG | 9 |

TABLE XLVII

V25-HLA-DR1-0301-15mers-98P4B6
Each peptide is a portion of SEQ ID NO: 51; each start position is specified, the length of peptide is 15 amino acids, and the end position for each peptide is the start position plus fourteen.

| Pos | 123456789012345 | score |
|---|---|---|
| 6 | IILFLPCISQKLKRI | 21 |
| 7 | ILFLPCISQKLKRIK | 18 |
| 14 | SQKLKRIKKGWEKSQ | 18 |
| 10 | LPCISQKLKRIKKGW | 17 |
| 3 | LGKIILFLPCISQKL | 13 |
| 4 | GKIILFLPCISQKLK | 13 |
| 5 | KIILFLPCISQKLKR | 11 |

TABLE XLVIII

V1-HLA-DR1-0401-15mers-98P4B6
Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 420 | EEEYYRFYTPPNFVL | 28 |
| 98 | YTSLWDLRHLLVGKI | 26 |
| 109 | VGKILIDVSNNMRIN | 26 |
| 175 | RQQVIELARQLNFIP | 26 |
| 205 | PLRLFTLWRGPVVVA | 26 |
| 213 | RGPVVVAISLATFFF | 26 |
| 225 | FFFLYSFVRDVIHPY | 26 |
| 229 | YSFVRDVIHPYARNQ | 26 |
| 312 | FAMVHVAYSLCLPMR | 26 |
| 370 | LLSLLAVTSIPSVSN | 26 |
| 373 | LLAVTSIPSVSNALN | 26 |
| 376 | VTSIPSVSNALNWRE | 26 |
| 38 | SGDFAKSLTIRLIRC | 22 |
| 51 | RCGYHVVIGSRNPKF | 22 |

TABLE XLVIII-continued

V1-HLA-DR1-0401-15mers-98P4B6
Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 62 | NPKFASEFFPHVVDV | 22 |
| 87 | NIIFVAIHREHYTSL | 22 |
| 143 | VKGFNVVSAWALQLG | 22 |
| 163 | RQVYICSNNIQARQQ | 22 |
| 184 | QLNFIPIDLGSLSSA | 22 |
| 222 | LATFFFLYSFVRDVI | 22 |
| 244 | QSDFYKIPIEIVNKT | 22 |
| 307 | LLSFFFAMVHVAYSL | 22 |
| 309 | SFFFAMVHVAYSLCL | 22 |
| 328 | SERYLFLNMAYQQVH | 22 |
| 346 | ENSWNEEEVWRIEMY | 22 |
| 357 | IEMYISFGIMSLGLL | 22 |
| 385 | ALNWREFSFIQSTLG | 22 |
| 388 | WREFSFIQSTLGYVA | 22 |
| 405 | ISTFHVLIYGWKRAF | 22 |
| 423 | YRFYTPPNFVLALV | 22 |
| 429 | PPNFVLALVLPSIVI | 22 |
| 1 | MESISMMGSPKSLSE | 20 |
| 15 | ETCLPNGINGIKDAR | 20 |
| 19 | PNGINGIKDARKVTV | 20 |
| 22 | INGIKDARKVTVGVI | 20 |
| 30 | KVTVGVIGSGDFAKS | 20 |
| 47 | IRLIRCGYHVVIGSR | 20 |
| 53 | GYHVVIGSRNPKFAS | 20 |
| 70 | FPHVVDVTHHEDALT | 20 |
| 71 | PHVVDVTHHEDALTK | 20 |
| 86 | TNILFVATHREHYTS | 20 |
| 90 | FVAIHREHYTSLWDL | 20 |
| 101 | LWDLRHLLVGKILID | 20 |
| 106 | HLLVGKILIDVSNNM | 20 |
| 110 | GKILIDVSNNMRINQ | 20 |
| 111 | KILIDVSNNMRINQY | 20 |
| 113 | LIDVSNNMRINQYPE | 20 |
| 130 | AEYLASLFPDSLIVK | 20 |
| 133 | LASLFPDSLIVKGFN | 20 |
| 139 | DSLIVKGFNVVSAWA | 20 |
| 140 | SLIVKGFNVVSAWAL | 20 |
| 145 | GFNVVSAWALQLGPK | 20 |
| 162 | SRQVYICSNNIQARQ | 20 |
| 176 | QQVIELARQLNFIPI | 20 |
| 185 | LNFIPIDLGSLSSAR | 20 |
| 189 | PIDLGSLSSAREIEN | 20 |
| 192 | LGSLSSAREIENLPL | 20 |
| 217 | VVAISLATFFFLYSF | 20 |
| 219 | AISLATFFFLYSFVR | 20 |
| 233 | RDVIHPYARNQQSDF | 20 |
| 247 | FYKIPIEIVNKTLPI | 20 |
| 256 | NKTLPIVAITLLSLV | 20 |
| 258 | TLPIVAITLLSLVYL | 20 |
| 261 | IVAITLLSLVYLAGL | 20 |
| 264 | ITLLSLVYLAGLLAA | 20 |
| 266 | LLSLVYLAGLLAAAY | 20 |
| 267 | LSLVYLAGLLAAAYQ | 20 |
| 273 | AGLLAAAYQLYYGTK | 20 |
| 292 | PPWLETWLQCRKQLG | 20 |
| 302 | RKQLGLLSFFFAMVH | 20 |
| 304 | QLGLLSFFFAMVHVA | 20 |
| 331 | YLFLNMAYQQVHANI | 20 |
| 351 | EEEVWRIEMYISFGI | 20 |
| 354 | VWRIEMYISFGIMSL | 20 |
| 362 | SFGIMSLGLLSLLAV | 20 |
| 365 | IMSLGLLSLLAVTSI | 20 |
| 367 | SLGLLSLLAVTSIPS | 20 |
| 368 | LGLLSLLAVTSIPSV | 20 |
| 379 | IPSVSNALNWREFSF | 20 |
| 395 | QSTLGYVALLISTFH | 20 |
| 398 | LGYVALLISTFHVLI | 20 |
| 401 | VALLISTFHVLIYGW | 20 |
| 430 | PNFVLALVLPSIVIL | 20 |
| 431 | NFVLALVLPSIVILD | 20 |
| 435 | ALVLPSIVILDLLQL | 20 |

TABLE XLVIII-continued

V1-HLA-DR1-0401-15mers-98P4B6
Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 438 | LPSIVILDLLQLCRY | 20 |
| 440 | SIVTLDLLQLCRYPD | 20 |
| 12 | SLSETCLPNGINGIK | 18 |
| 21 | GINGIKDARKVTVGV | 18 |
| 36 | IGSGDFAKSLTIRLI | 18 |
| 76 | VTHHEDALTKTNIIF | 18 |
| 97 | HYTSLWDLRHLLVGK | 18 |
| 142 | IVKGFNVVSAWALQL | 18 |
| 154 | LQLGPKDASRQVYIC | 18 |
| 161 | ASRQVYICSNNIQAR | 18 |
| 168 | CSNNIQARQQVIELA | 18 |
| 186 | NFIPIDLGSLSSARE | 18 |
| 195 | LSSAREIENLPLRLF | 18 |
| 234 | DVIHPYARNQQSDFY | 18 |
| 248 | YKIPIEIVNKTLPIV | 18 |
| 257 | KTLPIVAITLLSLVY | 18 |
| 289 | RRFPPWLETWLQCRK | 18 |
| 339 | QQVHANIENSWNEEE | 18 |
| 348 | SWNEEEVWRIEMYIS | 18 |
| 359 | MYISFGIMSLGLLSL | 18 |
| 364 | GIMSLGLLSLLAVTS | 18 |
| 384 | NALNWREFSFIQSTL | 18 |
| 387 | NWREFSFIQSTLGYV | 18 |
| 399 | GYVALLISTFHVLIY | 18 |
| 432 | FVLALVLPSIVILDL | 18 |
| 66 | ASEFFPHVVDVTHHE | 16 |
| 67 | SEFFPHVVDVTHHED | 16 |
| 95 | REHYTSLWDLRHLLV | 16 |
| 122 | INQYPESNAEYLASL | 16 |
| 129 | NAEYLASLFPDSLIV | 16 |
| 206 | LRLFTLWRGPVVVAI | 16 |
| 209 | FTLWRGPVVVAISLA | 16 |
| 224 | TFFFLYSFVRDVIHP | 16 |
| 226 | FFLYSFVRDVIHPYA | 16 |
| 228 | LYSFVRDVIHPYARN | 16 |
| 236 | IHPYARNQQSDFYKI | 16 |
| 245 | SDFYKIPIEIVNKTL | 16 |
| 268 | SLVYLAGLLAAAYQL | 16 |
| 285 | GTKYRRFPPWLETWL | 16 |
| 288 | YRRFPPWLETWLQCR | 16 |
| 308 | LSFFFAMVHVAYSLC | 16 |
| 330 | RYLFLNMAYQQVHAN | 16 |
| 335 | NMAYQQVHANIENSW | 16 |
| 352 | EEVWRIEMYISFGIM | 16 |
| 360 | YISFGIMSLGLLSLL | 16 |
| 390 | EFSFIQSTLGYVALL | 16 |
| 397 | TLGYVALLISTFHVL | 16 |
| 412 | IYGWKRAFEEEYYRF | 16 |
| 416 | KRAFEEEYYRFYTPP | 16 |
| 424 | YRFYTPPNFVLALVL | 16 |
| 296 | ETWLQCRKQLGLLSF | 15 |
| 3 | SISMMGSPKSLSETC | 14 |
| 4 | ISMMGSPKSLSETCL | 14 |
| 32 | TVGVIGSGDFAKSLT | 14 |
| 33 | VGVIGSGDFAKSLTI | 14 |
| 44 | SLTIRLIRCGYHVVI | 14 |
| 46 | TIRLIRCGYHVVIGS | 14 |
| 54 | YHVVIGSRNPKFASE | 14 |
| 73 | VVDVTHHEDALTKTN | 14 |
| 80 | EDALTKTNIIFVAIH | 14 |
| 85 | KTNIIFVAIHREHYT | 14 |
| 88 | IIFVAIHREHYTSLW | 14 |
| 117 | SNNMRINQYPESNAE | 14 |
| 119 | NMRINQYPESNAEYL | 14 |
| 151 | AWALQLGPKDASRQV | 14 |
| 178 | VIELARQLNFIPIDL | 14 |
| 182 | ARQLNFIPIDLGSLS | 14 |
| 187 | FIPIDLGSLSSAREI | 14 |
| 198 | AREIENLPLRLFTLW | 14 |
| 203 | NLPLRLFTLWRGPVV | 14 |
| 208 | LFTLWRGPVVVAISL | 14 |

TABLE XLVIII-continued

V1-HLA-DR1-0401-15mers-98P4B6
Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 214 | GPVVVAISLATFFFL | 14 |
| 232 | VRDVIHPYARNQQSD | 14 |
| 249 | KIPIEIVNKTLPIVA | 14 |
| 252 | IEIVNKTLPIVAITL | 14 |
| 259 | LPIVAITLLSLVYLA | 14 |
| 263 | AITLLSLVYLAGLLA | 14 |
| 269 | LVYLAGLLAAAYQLY | 14 |
| 272 | LAGLLAAAYQLYYGT | 14 |
| 305 | LGLLSFFFAMVHVAY | 14 |
| 311 | FFAMVHVAYSLCLPM | 14 |
| 314 | MVHVAYSLCLPMRRS | 14 |
| 318 | AYSLCLPMRRSERYL | 14 |
| 322 | CLPMRRSERYLFLNM | 14 |
| 329 | ERYLFLNMAYQQVHA | 14 |
| 333 | FLNMAYQQVHANIEN | 14 |
| 342 | HANIENSWNEEEVWR | 14 |
| 356 | RIEMYISFGIMSLGL | 14 |
| 363 | FGIMSLGLLSLLAVT | 14 |
| 371 | LSLLAVTSIPSVSNA | 14 |
| 391 | FSFIQSTLGYVALLI | 14 |
| 400 | YVALLISTFHVLIYG | 14 |
| 402 | ALLISTFHVLIYGWK | 14 |
| 407 | TFHVLIYGWKRAFEE | 14 |
| 409 | HVLIYGWKRAFEEEY | 14 |
| 433 | VLALVLPSIVILDLL | 14 |
| 439 | PSIVILDLLQLCRYP | 14 |

TABLE XLVIII

V5A-HLA-DRB1-0401-15mers-98P4B6
Each peptide is a portion of SEQ ID NO: 11; each start position is specified, the length of peptide is 15 amino acids, and the end position for each peptide is the start position plus fourteen.

| Pos | 123456789012345 | score |
|---|---|---|
| 14 | SSGFTPFSCLSLPSS | 22 |
| 17 | FTPFSCLSLPSSWDY | 22 |
| 3 | SPGLQALSLSLSSGF | 20 |

TABLE XLVIII-continued

V5A-HLA-DRB1-0401-15mers-98P4B6
Each peptide is a portion of SEQ ID NO: 11; each start position is specified, the length of peptide is 15 amino acids, and the end position for each peptide is the start position plus fourteen.

| Pos | 123456789012345 | score |
|---|---|---|
| 10 | SLSLSSGFTPFSCLS | 20 |
| 2 | GSPGLQALSLSLSSG | 18 |
| 7 | QALSLSSSGFTPFS | 18 |
| 28 | SWDYRCPPPCPADFF | 16 |
| 6 | LQALSLSSGFTPF | 14 |
| 20 | FSCLSLPSSWDYRCP | 14 |
| 4 | PGLQALSLSLSSGFT | 12 |
| 13 | LSSGFTPFSCLSLPS | 12 |
| 16 | GFTPFSCLSLPSSWD | 12 |
| 19 | PFSCLSLPSSWDYRC | 12 |
| 24 | SLPSSWDYRCPPPCP | 12 |

TABLE XLVIII

V5B-HLA-DRB1-0401-15mers-98P4B6
Each peptide is a portion of SEQ ID NO: 11; each start position is specified, the length of peptide is 15 amino acids, and the end position for each peptide is the start position plus fourteen.

| Pos | 123456789012345 | score |
|---|---|---|
| 4 | ALNWREFSFIQIFCS | 22 |
| 7 | WREFSFIQIECSFAD | 22 |
| 9 | EFSFIQIFGSFADTQ | 22 |
| 13 | IQIFCSFADTQTELE | 22 |
| 10 | FSFIQIFCSFADTQT | 20 |
| 23 | QTELELEFVFLLTLL | 20 |
| 3 | NALNWREFSFIQIFC | 18 |
| 15 | IFGSFADTQTELELE | 18 |
| 16 | FCSFADTQTELELEF | 16 |
| 12 | FIQIFCSFADTQTEL | 14 |
| 6 | NWREFSFIQIFCSFA | 12 |
| 14 | QIFCSFADTQTELEL | 12 |
| 20 | ADTQTELELEFVFLL | 12 |
| 22 | TQTELELEFVFLLTL | 12 |
| 24 | TELELEFVFLLTLLL | 12 |

TABLE XLVIII

V6-HLA-DRB1-0401-15mers-98P4B6
Each peptide is a portion of SEQ ID NO: 13; each start position is specified, the length of peptide is 15 amino acids, and the end position for each peptide is the start position plus fourteen.

| Pos | 123456789012345 | score |
|---|---|---|
| 18 | ILFLPCISRKLKRTK | 26 |
| 17 | IILFLPCISRKLKRI | 22 |
| 37 | KSQFLEEGIGGTIPH | 22 |
| 1 | NFVLALVLPSIVILG | 20 |
| 5 | ALVLPSIVILGKIIL | 20 |
| 8 | LPSIVILGKIILFLP | 20 |
| 14 | LGKIILFLPCISRKL | 20 |
| 46 | GGTIPHVSPERVTVM | 20 |
| 2 | FVLALVLPSIVILGK | 18 |
| 22 | PCISRKLKRIKKGWE | 18 |
| 30 | RIKXGWEKSQFLEEG | 18 |
| 3 | VLALVLPSIVILGKI | 14 |
| 11 | IVILGKIILFLPCIS | 14 |
| 15 | GKIILFLPCISRKLK | 14 |
| 16 | KIILFLPCISRKLKR | 14 |
| 25 | SRKLKRIKKGWEKSQ | 14 |
| 28 | LKRIKXGWEKSQFLE | 14 |
| 38 | SQFLEEGIGGTIPHV | 14 |
| 42 | EEGIGGTIPHVSPER | 14 |
| 6 | LVLPSIVILGKIILF | 12 |
| 7 | VLPSIVILGKIILFL | 12 |
| 13 | ILGKIILFLPCISRK | 12 |
| 34 | GWEKSQFLEEGIGGT | 12 |
| 43 | EGIGGTIPHVSPERV | 12 |

TABLE XLVIII

V7A-HLA-DRB1-0401-15mers-98P4B6
Each peptide is a portion of SEQ ID NO: 15; each start position is specified, the length of peptide is 15 amino acids, and the end position for each peptide is the start position plus fourteen.

| Pos | 123456789012345 | score |
|---|---|---|
| 13 | ETFLPNGINGIKDAR | 20 |
| 10 | SLSETFLPNGINGIK | 18 |
| 12 | SETFLPNGINGIKDA | 16 |
| 1 | SISMMGSPKSLSETF | 14 |
| 2 | ISMMGSPKSLSETFL | 14 |

TABLE XLVIII-continued

V7A-HLA-DRB1-0401-15mers-98P4B6
Each peptide is a portion of SEQ ID NO: 15; each start position is specified, the length of peptide is 15 amino acids, and the end position for each peptide is the start position plus fourteen.

| Pos | 123456789012345 | score |
|---|---|---|
| 5 | MGSPKSLSETFLPNG | 12 |
| 7 | SPKSLSETFLPNGIN | 12 |
| 9 | KSLSETFLPNGINGI | 12 |

TABLE XLVIII

V7B-HLA-DRB1-0401-15mers-98P4B6
Each peptide is a portion of SEQ ID NO: 15; each start position is specified, the length of peptide is 15 amino acids, and the end position for each peptide is the start position plus fourteen.

| Pos | 123456789012345 | score |
|---|---|---|
| 5 | YLFLNMAYQQSTLGY | 26 |
| 2 | SERYLFLNMAYQQST | 22 |
| 14 | QSTLGYVALLISTFH | 20 |
| 4 | RYLFLNMAYQQSTLG | 16 |
| 9 | NMAYQQSTLGYVALL | 16 |
| 3 | ERYLFLNMAYQQSTL | 14 |
| 7 | FLNMAYQQSTLGYVA | 14 |
| 1 | RSERYLFLNMAYQQS | 12 |
| 6 | LFLNMAYQQSTLGYV | 12 |
| 11 | AYQQSTLGYVALLIS | 12 |
| 15 | STLGYVALLISTFHV | 12 |

TABLE XLVIII

V7C-HLA-DRB1-0401-15mers-98P4B6
Each peptide is a portion of SEQ ID NO: 15; each start position is specified, the length of peptide is 15 amino acids, and the end position for each peptide is the start position plus fourteen.

| Pos | 123456789012345 | score |
|---|---|---|
| 134 | GPLWEFLLRLLKSQA | 28 |
| 168 | SGTWMKLETIILSKL | 28 |
| 7 | PSIVILDLSVEVLAS | 26 |
| 13 | DLSVEVLASPAAAWK | 26 |
| 113 | DRALKAANSWRNPVL | 26 |
| 138 | EFLLRLLKSQAASGT | 26 |
| 150 | SGTLSLAFTSWSLGE | 26 |
| 176 | TIILSKLTQEQKSKH | 26 |
| 23 | AAAWKCLGANILRGG | 22 |

TABLE XLVIII-continued

V7C-HLA-DRB1-0401-15mers-98P4B6
Each peptide is a portion of SEQ ID NO: 15; each start position is specified, the length of peptide is 15 amino acids, and the end position for each peptide is the start position plus fourteen.

| Pos | 123456789012345 | score |
|---|---|---|
| 62 | PAMWTEEAGATAEAQ | 22 |
| 162 | LGEFLGSGTWMKLET | 22 |
| 3 | ALVLPSIVLLDLSVE | 20 |
| 8 | SIVILDLSVEVLASP | 20 |
| 31 | ANILRGGLSEIVLPI | 20 |
| 40 | EIVLPIEWQQDRKIP | 20 |
| 50 | DRKIPPLSTPPPPAM | 20 |
| 61 | PPAMWTEEAGATAEA | 20 |
| 89 | QIPVVGVVTEDDEAQ | 20 |
| 92 | VVGVVTEDDEAQDSI | 20 |
| 130 | TNGVGPLWEFLLRLL | 20 |
| 133 | VGPLWEFLLRLLKSQ | 20 |
| 137 | WEFLLRLLKSQAASG | 20 |
| 159 | SWSLGEFLGSGTWMK | 20 |
| 169 | GTWMKLETIILSKLT | 20 |
| 171 | WMKLETIILSKLTQE | 20 |
| 27 | KCLGANILRGGLSEI | 18 |
| 74 | EAQESGIRNKSSSSS | 18 |
| 95 | VVTEDDEAQDSIDPP | 18 |
| 142 | RLLKSQAASGTLSLA | 18 |
| 151 | GTLSLAFTSWSLGEF | 18 |
| 172 | MKLETIILSKLTQEQ | 18 |
| 44 | PIEWQQDRKIPPLST | 16 |
| 119 | ANSWRNPVLPHTNGV | 16 |
| 157 | FTSWSLGEFLGSGTW | 16 |
| 77 | ESGIRNKSSSSSQIP | 15 |
| 175 | ETIILSKLTQEQKSK | 15 |
| 1 | VLALVLPSIVILDLS | 14 |
| 6 | LPSIVILDLSVEVLA | 14 |
| 9 | IVILDLSVEVLASPA | 14 |
| 11 | ILDLSVEVLASPAAA | 14 |
| 16 | VEVLASPAAAWKCLG | 14 |
| 30 | GANILRGGLSEIVLP | 14 |
| 35 | RGGLSEIVLPIEWQQ | 14 |
| 38 | LSEIVLPIEWQQDRK | 14 |
| 39 | SEIVLPIEWQQDRKI | 14 |

TABLE XLVIII-continued

V7C-HLA-DRB1-0401-15mers-98P4B6
Each peptide is a portion of SEQ ID NO: 15; each start position is specified, the length of peptide is 15 amino acids, and the end position for each peptide is the start position plus fourteen.

| Pos | 123456789012345 | score |
|---|---|---|
| 42 | VLPIEWQQDRKIPPL | 14 |
| 53 | IPPLSTPPPPAMWTE | 14 |
| 87 | SSQIPVVGVVTEDDE | 14 |
| 90 | IPVVGVVTEDDEAQD | 14 |
| 93 | VGVVTEDDEAQDSID | 14 |
| 103 | QDSIDPPESPDRALK | 14 |
| 123 | RNPVLPHTNGVGPLW | 14 |
| 141 | LRLLKSQAASGTLSL | 14 |
| 163 | GEFLGSGTWMKLETI | 14 |
| 179 | LSKLTQEQKSKHCMF | 14 |

TABLE XLVIII

V8-HLA-DRB1-0401-15mers-98P4B6
Each peptide is a portion of SEQ ID NO: 17; each start position is specified, the length of peptide is 15 amino acids, and the end position for each peptide is the start position plus fourteen.

| Pos | 123456789012345 | score |
|---|---|---|
| 7 | KSQFLEEGMGGTIPH | 22 |
| 8 | SQFLEEGMGGTIPHV | 14 |
| 12 | EEGMGGTLPHVSPER | 14 |
| 4 | GWEKSQFLEEGMGGT | 12 |
| 13 | EGMGGTIPHVSPERV | 12 |
| 2 | KKGWEKSQFLEEGMG | 10 |

TABLE XLVIII

V13-HLA-DRB1-0401-15mers-98P4B6
Each peptide is a portion of SEQ ID NO: 27; each start position is specified, the length of peptide is 15 amino acids, and the end position for each peptide is the start position plus fourteen.

| Pos | 123456789012345 | score |
|---|---|---|
| 13 | ETFLPNGINGIKDAR | 20 |
| 10 | SLSETFLPNGINGIK | 18 |
| 12 | SETFLPNGINGIKDA | 16 |
| 1 | SISMMGSPKSLSETF | 14 |
| 2 | ISMMGSPKSLSETFL | 14 |
| 5 | MGSPKSLSETFLPNG | 12 |

TABLE XLVIII-continued

V13-HLA-DRB1-0401-15mers-98P4B6
Each peptide is a portion of SEQ ID NO: 27; each start position is specified, the length of peptide is 15 amino acids, and the end position for each peptide is the start position plus fourteen.

| Pos | 123456789012345 | score |
|---|---|---|
| 7 | SPKSLSETFLPNGIN | 12 |
| 9 | KSLSETFLPNGINGI | 12 |

TABLE XLVIII

V14-HLA-DRB1-0401-15mers-98P4B6
Each peptide is a portion of SEQ ID NO: 29; each start position is specified, the length of peptide is 15 amino acids, and the end position for each peptide is the start position plus fourteen.

| Pos | 123456789012345 | score |
|---|---|---|
| 9 | PLRLFTFWRGPVVVA | 26 |
| 10 | LRLFTFWRGPVVVAI | 16 |
| 12 | LFTFWRGPVVVAISL | 16 |
| 13 | FTFWRGPVVVAISLA | 16 |
| 2 | AREIENLPRLFTFW | 14 |
| 7 | NLPLRLFTFWRGPVV | 14 |
| 3 | REIENLPRLFTFWR | 12 |
| 6 | ENLPLRLFTFWRGPV | 12 |
| 14 | TFWRGPVVVAISLAT | 12 |
| 15 | FWRGPVVVAISLATF | 12 |

TABLE XLVIII

V21-HLA-DRB1-0401-15mers-98P4B6
Each peptide is a portion of SEQ ID NO: 43; each start position is specified, the length of peptide is 15 amino acids, and the end position for each peptide is the start position plus fourteen.

| Pos | 123456789012345 | score |
|---|---|---|
| 3 | TIILSKLTQEQKTKH | 26 |
| 2 | ETIILSKLTQEQKTK | 15 |
| 6 | LSKLTQEQKTKHCMF | 14 |
| 5 | ILSKLTQEQKTKHCM | 12 |

TABLE XLVIII

V25-HLA-DRB1-0401-15mers-98P4B6
Each peptide is a portion of SEQ ID NO: 51; each start position is specified, the length of peptide is 15 amino acids, and the end position for each peptide is the start position plus fourteen.

| Pos | 123456789012345 | score |
|---|---|---|
| 7 | ILFLPCISQKLKRIK | 26 |
| 6 | IILFLPCISQKLKRI | 22 |

TABLE XLVIII-continued

V25-HLA-DRB1-0401-15mers-98P4B6
Each peptide is a portion of SEQ ID NO: 51; each start position is specified, the length of peptide is 15 amino acids, and the end position for each peptide is the start position plus fourteen.

| Pos | 123456789012345 | score |
|---|---|---|
| 3 | LGKIILFLPCISQKL | 20 |
| 4 | GKIILFLPCISQKLK | 20 |
| 11 | PCISQKLKRIKKGWE | 18 |
| 5 | KIILFLPCISQKLKR | 14 |
| 14 | SQKLKRIKKGWEKSQ | 14 |
| 2 | ILGKIILFLPCISQK | 12 |

TABLE XLIX

V1-HLA-DRB1-1101-15mers-98P4B6
Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 249 | KIPIEIVNKTLPIVA | 27 |
| 308 | LSFFFAMVHVAYSLC | 27 |
| 229 | YSFVRDVIHPYARNQ | 26 |
| 281 | QLYYGTKYRRFPPWL | 25 |
| 295 | LETWLQCRKQLGLLS | 25 |
| 87 | NIIFVAIHREHYTSL | 24 |
| 388 | WREFSFIQSTLGYVA | 23 |
| 309 | SFFFAMVHVAYSLCL | 22 |
| 3 | SISMMGSPKSLSETC | 21 |
| 71 | PHVVDVTHHEDALTK | 21 |
| 98 | YTSLWDLRHLLVGKI | 21 |
| 175 | RQQVIELARQLNFIP | 21 |
| 205 | PLRLFTLWRGPVVVA | 21 |
| 70 | FPHVVDVTHHEDALT | 20 |
| 95 | REHYTSLWDLRHLLV | 20 |
| 151 | AWALQLGPKDASRQV | 20 |
| 263 | AITLLSLVYLAGLLA | 20 |
| 1 | MESISMMGSPKSLSE | 19 |
| 51 | RCGYHVVIGSRNPKF | 19 |
| 106 | HLLVGKILIDVSNNM | 19 |
| 182 | ARQLNFIPIDLGSLS | 19 |
| 266 | LLSLVYLAGLLAAAY | 19 |
| 351 | EEEVWRIEMYISFGI | 19 |

TABLE XLIX-continued

V1-HLA-DRB1-1101-15mers-98P4B6
Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 395 | QSTLGYVALLISTFH | 19 |
| 424 | YRFYTPPNFVLALVL | 19 |
| 67 | SEFFPHVVDVTHHED | 18 |
| 222 | LATFFFLYSFVRDVI | 18 |
| 302 | RKQLGLLSFFFAMVH | 18 |
| 307 | LLSFFFAMVHVAYSL | 18 |
| 367 | SLGLLSLLAVTSIPS | 18 |
| 370 | LLSLLAVTSIPSVSN | 18 |
| 28 | ARKVTVGVIGSGDFA | 17 |
| 86 | TNIIFVAIHREHYTS | 17 |
| 99 | TSLWDLRHLLVGKIL | 17 |
| 134 | ASLFPDSLIVKGFNV | 17 |
| 143 | VKGFNVVSAWALQLG | 17 |
| 225 | FFFLYSFVRDVIHPY | 17 |
| 226 | FFLYSFVRDVIHPYA | 17 |
| 244 | QSDFYKIPIEIVNKT | 17 |
| 335 | NMAYQQVHANIENSW | 17 |
| 360 | YISFGIMSLGLLSLL | 17 |
| 405 | ISTFHVLIYGWKRAF | 17 |
| 129 | NAEYLASLFPDSLIV | 16 |
| 136 | LFPDSLIVKGFNVVS | 16 |
| 163 | RQVYICSNNIQARQQ | 16 |
| 184 | QLNFIPIDLGSLSSA | 16 |
| 268 | SLVYLAGLLAAAYQL | 16 |
| 279 | AYQLYYGTKYRRFPP | 16 |
| 282 | LYYGTKYRRFPPWLE | 16 |
| 328 | SERYLFLNMAYQQVH | 16 |
| 330 | RYLFLNMAYQQVHAN | 16 |
| 385 | ALNWREFSFIQSTLG | 16 |
| 397 | TLGYVALLISTFHVL | 16 |
| 429 | PPNFVLALVPSIVI | 16 |
| 42 | AKSLTIRLIRCGYHV | 15 |
| 47 | IRLIRCGYHVVIGSR | 15 |
| 103 | DLRHLLVGKILIDVS | 15 |
| 142 | IVKGFNVVSAWALQL | 15 |

TABLE XLIX-continued

V1-HLA-DRB1-1101-15mers-98P4B6
Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 210 | TLWRGPVVVAISLAT | 15 |
| 317 | VAYSLCLPMRRSERY | 15 |
| 318 | AYSLCLPMRRSERYL | 15 |
| 322 | CLPMRRSERYLFLNM | 15 |
| 401 | VALLISTFHVLIYGW | 15 |
| 408 | FHVLIYGWKRAFEEE | 15 |
| 428 | TPPNFVLALVLPSIV | 15 |
| 19 | PNGINGIKDARKVTV | 14 |
| 22 | INGIKDARKVTVGVI | 14 |
| 43 | KSLTIRLIRCGYHVV | 14 |
| 52 | CGYHVVIGSRNPKFA | 14 |
| 53 | GYHVVIGSRNPKFAS | 14 |
| 56 | VVIGSRNPKFASEFF | 14 |
| 66 | ASEFFPHVVDVTHHE | 14 |
| 77 | THHEDALTKTNIIFV | 14 |
| 85 | KTNIIFVAIHREHYT | 14 |
| 89 | IFVATHREHYTSLWD | 14 |
| 113 | LIDVSNNMRINQYPE | 14 |
| 189 | PIDLGSLSSAREIEN | 14 |
| 198 | AREIENLPLRLFTLW | 14 |
| 203 | NLPLRLFTLWRGPVV | 14 |
| 212 | WRGPVVVAISLATFF | 14 |
| 233 | RDVIHPYARNQQSDF | 14 |
| 261 | IVAITLLSLVYLAGL | 14 |
| 319 | YSLCLPMRRSERYLF | 14 |
| 348 | SWNEEEVWRIEMYIS | 14 |
| 373 | LLAVTSIPSVSNALN | 14 |
| 381 | SVSNALNWREFSFIQ | 14 |
| 407 | TFHVLIYGWKRAFEE | 14 |
| 409 | HVLIYGWKRAFEEEY | 14 |
| 430 | PNFVLALVPSIVIL | 14 |
| 435 | ALVLPSIVILDLLQL | 14 |
| 30 | KVTVGVIGSGDFAKS | 13 |
| 33 | VGVIGSGDFAKSLTI | 13 |
| 101 | LWDLRHLLVGKILID | 13 |
| 139 | DSLIVKGFNVVSAWA | 13 |

TABLE XLIX-continued

V1-HLA-DRB1-1101-15mers-98P4B6
Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 146 | FNVVSAWALQLGPKD | 13 |
| 178 | VIELARQLNFIPIDL | 13 |
| 185 | LNFIPIDLGSLSSAR | 13 |
| 206 | LRLFTLWRGPVVVAI | 13 |
| 208 | LFTLWRGPVVVAISL | 13 |
| 223 | ATFFFLYSFVRDVIH | 13 |
| 252 | IEIVNKTLPIVAITL | 13 |
| 256 | NKTLPIVAITLLSLV | 13 |
| 280 | YQLYYGTKYRRFPPW | 13 |
| 311 | FFAMVHVAYSLCLPM | 13 |
| 358 | EMYISFGIMSLGLLS | 13 |
| 364 | GIMSLGLLSLLAVTS | 13 |
| 376 | VTSIPSVSNALNWRE | 13 |
| 391 | FSFIQSTLGYVALLI | 13 |
| 431 | NFVLALVLPSIVILD | 13 |

TABLE XLIX

V2-HLA-DRB1-1101-15mers-98P4B6
Each peptide is a portion of SEQ ID NO: 5; each start position is specified, the length of peptide is 15 amino acids, and the end position for each peptide is the start position plus fourteen.

| Pos | 123456789012345 | score |
|---|---|---|
| 17 | FTPFSCLSLPSSWDY | 22 |
| 3 | SPGLQALSLSLSSGF | 19 |
| 28 | SWDYRCPPPCPADFF | 16 |
| 24 | SLPSSWDYRCPPPCP | 14 |
| 5 | GLQALSLSLSSGFTP | 12 |
| 8 | ALSLSLSSGFTPFSC | 12 |
| 10 | SLSLSSGFTPFSCLS | 12 |
| 14 | SSGFTPFSCLSLPSS | 12 |
| 26 | PSSWDYRCPPPCPAD | 10 |

TABLE XLIX

V5A-HLA-DRB1-1101-15mers-98P4B6
Each peptide is a portion of SEQ ID NO: 11; each start position is specified, the length of peptide is 15 amino acids, and the end position for each peptide is the start position plus fourteen.

| Pos | 123456789012345 | score |
|---|---|---|
| 13 | LFTFWRGPVVVAISL | 17 |
| 10 | PLRIFTFWRGPVVVA | 15 |
| 15 | TFWRGPVVVAISLAT | 15 |
| 3 | AREIENLPLRLFTFW | 14 |
| 8 | NLPLRLFTFWRGPVV | 14 |
| 11 | LRLFTFWRGPVVVAI | 13 |
| 14 | FTFWRGPVVVAISLA | 12 |
| 16 | FWRGPVVVAISLATF | 9 |
| 4 | REIENLPLRLFTFWR | 8 |

TABLE XLIX

V5B-HLA-DRB1-1101-15mers-98P4B6
Each peptide is a portion of SEQ ID NO: 11; each start position is specified, the length of peptide is 15 amino acids, and the end position for each peptide is the start position plus fourteen.

| Pos | 123456789012345 | score |
|---|---|---|
| 7 | WREFSFIQIFCSFAD | 22 |
| 9 | EFSFIQIFCSFADTQ | 22 |
| 16 | FCSFADTQTELELEF | 11 |
| 4 | ALNWREFSFIQIFCS | 10 |
| 13 | IQIFCSFADTQTELE | 10 |

TABLE XLIX

V6-HLA-DRB1-1101-15mers-98P4B6
Each peptide is a portion of SEQ ID NO: 13; each start position is specified, the length of peptide is 15 amino acids, and the end position for each peptide is the start position plus fourteen.

| Pos | 123456789012345 | score |
|---|---|---|
| 8 | LPSIVILGKIILFLP | 21 |
| 18 | ILFLPCISRKLKRIK | 21 |
| 25 | SRKLKRIKKGWEKSQ | 20 |
| 43 | EGIGGTIPHVSPERV | 20 |
| 11 | IVILGKIILFLPCIS | 19 |

TABLE XLIX-continued

V6-HLA-DRB1-1101-
15mers-98P4B6
Each peptide is a portion of
SEQ ID NO: 13; each start
position is specified, the
length of peptide is 15 amino
acids, and the end position
for each peptide is the start
position plus fourteen.

| Pos | 123456789012345 | score |
|---|---|---|
| 21 | LPCISRKLKRIKKGW | 16 |
| 22 | PCISRKLKRIKKGWE | 15 |
| 5 | ALVLPSIVILGKIIL | 14 |
| 46 | GGTIPHVSPERVTVM | 14 |
| 1 | NFVLALVLPSIVILG | 13 |
| 4 | LALVLPSIVILGKII | 13 |
| 14 | LGKIILFLPCISRKL | 13 |
| 35 | WEKSQFLEEGIGGTI | 13 |
| 39 | QFLEEGIGGTIPHVS | 13 |
| 42 | EEGIGGTIPHVSPER | 13 |
| 15 | GKIILFLPCISRKLK | 12 |
| 17 | IILFLPCISRKLKRI | 12 |
| 32 | KKGWEKSQFLEEGIG | 10 |
| 37 | KSQFLEEGIGGTIPH | 10 |

TABLE XLIX

V7A-HLA-DRB1-1101-
15mers-98P4B6
Each peptide is a portion of
SEQ ID NO: 15; each start
position is specified, the
length of peptide is 15 amino
acids, and the end position
for each peptide is the start
position plus fourteen.

| Pos | 123456789012345 | score |
|---|---|---|
| 1 | SISMMGSPKSLSETF | 21 |
| 8 | PKSLSETFLPNGING | 12 |
| 12 | SETFLPNGINGIKDA | 10 |

TABLE XLIX

V7B-HLA-DRB1-1101-
15mers-98P4B6
Each peptide is a portion of
SEQ ID NO: 15; each start
position is specified, the
length of peptide is 15 amino
acids, and the end position
for each peptide is the start
position plus fourteen.

| Pos | 123456789012345 | score |
|---|---|---|
| 4 | RYLFLNMAYQQSTLG | 22 |
| 14 | QSTLGYVALLISTFH | 19 |
| 2 | SERYLFLNMAYQQST | 16 |
| 7 | FLNMAYQQSTLGYVA | 13 |
| 9 | NMAYQQSTLGYVALL | 10 |

TABLE XLIX

V7C-HLA-DRB1-1101-
15mers-98P4B6
Each peptide is a portion of
SEQ ID NO: 15; each start
position is specified, the
length of peptide is 15 amino
acids, and the end position
for each peptide is the start
position plus fourteen.

| Pos | 123456789012345 | score |
|---|---|---|
| 137 | WEFLLRLLKSQAASG | 26 |
| 134 | GPLWEFLLRLLKSQA | 25 |
| 44 | PIEWQQDRKIPPLST | 24 |
| 121 | SWRNPVLPHTNGVGP | 21 |
| 13 | DLSVEVLASPAAAWK | 19 |
| 50 | DRKIPPLSTPPPPAM | 18 |
| 62 | PAMWTEEAGATAEAQ | 18 |
| 138 | EFLLRLLKSQAASGT | 18 |
| 23 | AAAWKCLGANILRGG | 17 |
| 168 | SGTWMKLETIILSKL | 17 |
| 179 | LSKLTQEQKSKHCMF | 17 |
| 157 | FTSWSLGEFLGSGTW | 16 |
| 9 | IVILDLSVEVLASPA | 15 |
| 11 | ILDLSVEVLASPAAA | 15 |
| 19 | LASPAAAWKCLGANI | 15 |
| 35 | RGGLSEIVLPIEWQQ | 15 |
| 43 | LPIEWQQDRKIPPLS | 15 |
| 73 | AEAQESGIRNKSSSS | 15 |
| 3 | ALVLPSIVILDLSVE | 14 |
| 27 | KCLGANILRGGLSEI | 14 |

TABLE XLIX-continued

V7C-HLA-DRB1-1101-
15mers-98P4B6
Each peptide is a portion of
SEQ ID NO: 15; each start
position is specified, the
length of peptide is 15 amino
acids, and the end position
for each peptide is the start
position plus fourteen.

| Pos | 123456789012345 | score |
|---|---|---|
| 75 | AQESGIRNKSSSSSQ | 14 |
| 89 | QIPVVGVVTEDDEAQ | 14 |
| 135 | PLWEFLLRLLKSQAA | 14 |
| 173 | KLETIILSKLTQEQK | 14 |
| 4 | LVLPSIVILDLSVEV | 13 |
| 6 | LPSIVILDLSVEVLA | 13 |
| 8 | SIVILDLSVEVLASP | 13 |
| 26 | WKCLGANILRGGLSE | 13 |
| 28 | CLGANILRGGLSEIV | 13 |
| 87 | SSQIPVVGVVTEDDE | 13 |
| 90 | IPVVGVVTEDDEAQD | 13 |
| 123 | RNPVLPHTNGVGPLW | 13 |
| 130 | TNGVGPLWEFLLRLL | 13 |
| 152 | TLSLAFTSWSLGEFL | 13 |
| 156 | AFTSWSLGEFLGSGT | 13 |
| 169 | GTWMKLETIILSKLT | 13 |
| 171 | WMKLETIILSKLTQE | 13 |
| 10 | VILDLSVEVLASPAA | 12 |
| 12 | LDLSVEVLASPAAAW | 12 |
| 39 | SEIVLPIEWQQDRKI | 12 |
| 58 | TPPPPAMWTEEAGAT | 12 |
| 74 | EAQESGIRNKSSSSS | 12 |
| 77 | ESGIRNKSSSSSQIP | 12 |
| 100 | DEAQDSIDPPESPDR | 12 |
| 110 | ESPDRALKAANSWRN | 12 |
| 119 | ANSWRNPVLPHTNGV | 12 |
| 124 | NPVLPHTNGVGPLWE | 12 |
| 140 | LLRLLKSQAASGTLS | 12 |
| 150 | SGTLSLAFTSWSLGE | 12 |
| 154 | SLAFTSWSLGEFLGS | 12 |
| 176 | TIILSKLTQEQKSKH | 12 |

TABLE XLIX

V8-HLA-DRB1-1101-
15mers-98P4B6
Each peptide is a portion of
SEQ ID NO: 17; each start
position is specified, the
length of peptide is 15 amino
acids, and the end position
for each peptide is the start
position plus fourteen.

| Pos | 123456789012345 | score |
|---|---|---|
| 13 | EGMGGTIPHVSPERV | 20 |
| 9 | QFLEEGMGGTIPHVS | 13 |
| 12 | EEGMGGTIPHVSPER | 13 |
| 5 | WEKSQFLEEGMGGTI | 12 |
| 2 | KKGWEKSQFLEEGMG | 10 |
| 7 | KSQFLEEGMGGTIPH | 10 |

TABLE XLIX

V13-HLA-DRB1-1101-
15mers-98P4B6
Each peptide is a portion of
SEQ ID NO: 27; each start
position is specified, the
length of peptide is 15 amino
acids, and the end position
for each peptide is the start
position plus fourteen.

| Pos | 123456789012345 | score |
|---|---|---|
| 1 | SISMMGSPKSLSETF | 21 |
| 8 | PKSLSETFLPNGING | 12 |
| 12 | SETFLPNGINGIKDA | 10 |

TABLE XLIX

V14-HLA-DRB1-1101-
15mers-98P4B6
Each peptide is a portion of
SEQ ID NO: 29; each start
position is specified, the
length of peptide is 15 amino
acids, and the end position
for each peptide is the start
position plus fourteen.

| Pos | 123456789012345 | score |
|---|---|---|
| 12 | LFTFWRGPVVVAISL | 17 |
| 9 | PLRLFTFWRGPVVVA | 15 |
| 14 | TFWRGPVVVAISLAT | 15 |
| 2 | AREIENLPLRLFTFW | 14 |
| 7 | NLPLRLFTFWRGPVV | 14 |
| 10 | LRLFTFWRGPVVVAI | 13 |
| 13 | FTFWRGPVVVAISLA | 12 |
| 15 | FWRGPVVVAISLATF | 9 |
| 3 | REIENLPLRLFTFWR | 8 |

TABLE XLIX

V21-HLA-DRB1-1101-15mers-98P4B6
Each peptide is a portion of SEQ ID NO: 43; each start position is specified, the length of peptide is 15 amino acids, and the end position for each peptide is the start position plus fourteen.

| Pos | 123456789012345 | score |
|---|---|---|
| 6 | LSKLTQEQKTKHCMF | 17 |
| 3 | TIILSKLTQEQKTKH | 12 |
| 8 | KLTQEQKTKHCMFSL | 8 |
| 9 | LTQEQKTKHCMFSLI | 8 |

TABLE XLIX

V25-HLA-DRB1-1101-15mers-98P4B6
Each peptide is a portion of SEQ ID NO: 51; each start position is specified, the length of peptide is 15 amino acids, and the end position for each peptide is the start position plus fourteen.

| Pos | 123456789012345 | score |
|---|---|---|
| 14 | SQKLKRIKKGWEKSQ | 20 |
| 10 | LPCISQKLKRIKKGW | 16 |
| 11 | PCISQKLKRIKKGWE | 15 |
| 3 | LGKIILFLPCISQKL | 13 |
| 7 | ILFLPCISQKLKRIK | 13 |
| 4 | GKIILFLPCISQKLK | 12 |
| 6 | IILFLPCISQKLKRI | 11 |
| 8 | LFLPCISQKLKRIKK | 9 |

TABLE L

Properties of 98P4B6

| V.1 | Bioinformatic Program | Outcome |
|---|---|---|
| ORF | ORF finder | |
| Protein length | | 454 aa |
| Transmembrane region | TM Pred | 6TM, aa 214-232, 261-286, 304-325, 359-379, 393-415, 426-447, N-term inside |
| | HMMTop | 6TM, aa 215-232 261-279 306-325 360-379 396-415 428-447 N-term ou |
| | Sosui | 6TM, aa 206-228, 255-277, 304-325, 359-381, 393-415, 428-450 |
| | TMHMM | 6TM, aa 210-232, 262-284, 304-323, 360-382, 392-414, 427-449 |
| Signal Peptide | Signal P | none |
| pI | pI/MW tool | pI 8.74 |
| Molecular weight | pI/MW tool | 52.0 kD |
| Localization | PSORT | Plasma membrane 60%, golgi 40% |
| | PSORT II | Endoplasmic reticulum 39%, plasma membrane 34% |
| Motifs | Pfam | no known motifs |
| | Prints | pyridine nucleotide reductase |
| | ProDom | Dudulin, oxidoreductase |
| | Blocks | adenosyl-L-homocysteine hydrolase |

| V.2 | Bioinformatic Program | Outcome |
|---|---|---|
| ORF | ORF finder | |
| Protein length | | 45 aa |
| Transmembrane region | TM Pred | 1TM, aa 5-23, N-term inside |
| | HMMTop | no TM |
| | Sosui | souble protein |
| | TMHMM | no TM |
| Signal Peptide | Signal P | none |
| pI | pI/MW tool | pI 4.2 |
| Molecular weight | pI/MW tool | 4.84 kD |
| Localization | PSORT | Ouside 37%, microbody 32% |
| | PSORT II | Extracellular 33%, nuclear 33% |
| Motifs | Pfam | no known motifs |
| | Prints | no known motifs |
| | Blocks | no known motifs |

TABLE L-continued

| V.5 | Bioinformatic Program | Outcome |
|---|---|---|
| ORF | ORF finder | |
| Protein length | | 419 aa |
| Transmembrane region | TM Pred | 4TM, aa 214-232, 261-286, 304-325, 359-379 N-term inside |
| | HMMTop | 4TM, aa 215-232, 259-278, 305-324, 360-379 N-term outside |
| | Sosui | 4TM, aa 209-231, 255-277, 304-325, 356-379 |
| | TMHMM | 4TM, aa 210-232, 262-284, 304-323, 360-382 |
| Signal Peptide | Signal P | none |
| pI | pI/MW tool | pI 8.1 |
| Molecular weight | pI/MW tool | 47.9 kD |
| Localization | PSORT | Plasma membrane 60%, golgi 40% |
| | PSORT II | Endoplasmic reticulum 44%, plasma membrane 22% |
| Motifs | Pfam | no known motifs |
| | Prints | no known motifs |
| | ProDom | Dudulin, oxidoreductase |
| | Blocks | no known motifs |

| V.6 | Bioinformatic Program | Outcome |
|---|---|---|
| ORF | ORF finder | |
| Protein length | | 490 aa |
| Transmembrane region | TM Pred | 6TM, aa 214-232, 261-286, 304-325, 359-379, 393-415, 432-455 |
| | HMMTop | 7TM, aa 140-158, 214-232, 259-280, 305-323, 361-383, 396-413, 432-455, N-term out |
| | Sosui | 6TM, aa 206-228, 255-277, 304-325, 359-381, 393-415, 428-450 |
| | TMHMM | 6TM, aa 210-232, 262-284, 304-323, 360-382, 392-414, 427-449 |
| Signal Peptide | Signal P | none |
| pI | pI/MW tool | pI 9.2 |
| Molecular weight | pI/MW tool | 55.9 kD |
| Localization | PSORT | Plasma membrane 60%, golgi 40% |
| | PSORT II | Endoplasmic reticulum 39%, plasma membrane 34% |
| Motifs | Pfam | no known motifs |
| | Prints | pyridine nucleotide reductase |
| | ProDom | Dudulin, oxidoreductase |
| | Blocks | adenosyl-L-homocysteine hydrolase |

| V.7 | Bioinformatic Program | Outcome |
|---|---|---|
| ORF | ORF finder | |
| Protein length | | 576 aa |
| Transmembrane region | TM Pred | 6TM, aa 214-232, 262-280, 306-322, 331-360, 371-393, 525-544. N-term out |
| | HMMTop | 5TM, aa 215-232, 261-279, 306-325, 342-359, 378-397 N-term out |
| | Sosui | 5TM, aa 206-228, 255-277, 304-325, 339-360, 380-402 |
| | TMHMM | 4TM, aa 210-232, 262-284, 304-323, 343-360 |
| Signal Peptide | Signal P | none |
| pI | pI/MW tool | pI 8.5 |
| Molecular weight | pI/MW tool | 64.5 kD |
| Localization | PSORT | Plasma membrane 60%, golgi 40% |
| | PSORT II | Endoplasmic reticulum 44%, plasma membrane 22% |
| Motifs | Pfam | no known motifs |
| | Prints | pyridine nucleotide reductase |
| | ProDom | Dudulin, oxidoreductase |
| | Blocks | Ets domain, adenosyl-L-homocysteine hydrolase |

TABLE LI

Exon boundaries of transcript 98P4B6 v.1

| Exon Number | Start | End | Length |
|---|---|---|---|
| 1 | 23 | 321 | 299 |
| 2 | 322 | 846 | 525 |
| 3 | 847 | 1374 | 528 |
| 4 | 1375 | 1539 | 165 |
| 5 | 1540 | 1687 | 148 |
| 6 | 1688 | 2453 | 766 |

TABLE LII(a)

Nucleotide sequence (partial, 5' open) of transcript variant 98P4B6 v.2 (SEQ ID NO: 153)

```
agtggatccc ccgggctgca ggctctctct ctctctctct cttccgggtt cacgccattc      60
tcctgcctca gcctcccgag tagctgggac tacaggtgcc cgccaccatg cccggctgat     120
ttcttttgt  attttagta  cagacggagt tcaccgtgt  tagccaggat ggtctcgatc     180
tcctgacctc gtgatccgcc cgccttggcc tccaaagtgc tgggattaca ggtgtgagct     240
accgcgcccg gcctattatc ttgtactttc taactgagcc ctctatttc  tttatttaa      300
taatatttct ccccacttga gaatcacttg ttagttcttg gtaggaattc agttgggcaa     360
tgataacttt tatgggcaaa acattctat  tatagtgaac aaatgaaaat aacagcgtat     420
tttcaatatt ttcttattcc ttaaattcca ctcttttaac actatgctta accacttaat     480
gtgatgaaat attcctaaaa gttaaatgac tattaaagca tatattgttg catgtatata     540
ttaagtagcc gatactctaa ataaaaatac cactgttaca gataaatggg cctttaaaa     600
atatgaaaaa caaacttgtg aaaatgtata aagatgcat  ctgttgtttc aaatggcact     660
atcttctttt cagtactaca aaacagaat  aattttgaag ttttagaata aatgtaatat     720
atttactata attctaaatg tttaaatgct tttctaaaaa tgcaaaacta tgatgtttag     780
ttgctttatt ttacctctat gtgattattt tcttaattg  ttatttttta taatcattat     840
ttttctgaac cattcttctg gcctcagaag taggactgaa ttctactatt gctaggtgtg     900
agaaagtggt ggtgagaacc ttagagcagt ggagatttgc tacctggtct gtgttttgag     960
aagtgcccct tagaaagtta aagaatgta  gaaaagatac tcagtcttaa tcctatgcaa    1020
aaaaaaaatc aagtaattgt tttcctatga ggaaaataac catgagctgt atcatgctac    1080
ttagctttta tgtaaatatt tcttatgtct cctctattaa gagtatttaa aatcatattt    1140
aaatatgaat ctattcatgc taacattatt tttcaaaaca tacatggaaa tttagcccag    1200
attgtctaca tataaggttt ttatttgaat tgtaaaatat ttaaaagtat gaataaaata    1260
tatttatagg tatttatcag agatgattat tttgtgctac atacaggttg gctaatgagc    1320
tctagtgtta aactacctga ttaatttctt ataaagcagc ataaccttgg cttgattaag    1380
gaattctact ttcaaaaatt aatctgataa tagtaacaag gtatattata cttcattac     1440
aatcaaatta tagaaattac ttgtgtaaaa gggcttcaag aatatatcca atttttaaat    1500
attttaatat atctcctatc tgataactta attcttctaa attaccactt gccattaagc    1560
tatttcataa taaattctgt acagtttccc ccaaaaaaag agatttattt atgaaatatt    1620
taaagtttct aatgtggtat tttaataaa  gtatcataaa tgtaataagt aaatatttat    1680
ttaggaatac tgtgaacact gaactaatta ttcctgtgtc agtctatgaa atccctgttt    1740
tgaaataagt aaacagccta aaatgtgttg aaattatttt gtaaatccat gacttaaaac    1800
aagatacata catagtataa cacacctcac agtgttaaga tttatattgt gaaatgagac    1860
accctacctt caattgttca tcagtgggta aaacaaattc tgatgtacat tcaggacaaa    1920
tgattagccc taaatgaaac tgtaataatt tcagtggaaa ctcaatctgt tttacccttt    1980
aaacagtgaa ttttacatga atgaatgggt tcttcacttt ttttttagta tgagaaaatt    2040
atacagtgct taattttcag agattctttc catatgttac taaaaaatgt tttgttcagc    2100
ctaacatact gagtttttt  taactttcta aattattgaa tttccatcat gcattcatcc    2160
aaaattaagg cagactgttt ggattcttcc agtggccaga tgagctaaat taaatcacaa    2220
aagcagatgc tttttgtatga tctccaaatt gccaacttta aggaaatatt ctcttgaaat    2280
```

TABLE LII(a)-continued

Nucleotide sequence (partial, 5' open) of transcript variant
98P4B6 v.2 (SEQ ID NO: 153)

```
tgtctttaaa gatcttttgc agctttgcag atacccagac tgagctggaa ctggaatttg   2340
tcttcctatt gactctactt ctttaaaagc ggctgcccat tacattcctc agctgtcctt   2400
gcagttaggt gtacatgtga ctgagtgttg gccagtgaga tgaagtctcc tcaaaggaag   2460
gcagcatgtg tccttttca tcccttcatc ttgctgctgg gattgtggat ataacaggag    2520
ccctggcagc tgtctccaga ggatcaaagc cacacccaaa gagtaaggca gattagagac   2580
cagaaagacc ttgactactt ccctacttcc actgcttttt cctgcattta agccattgta   2640
aatctgggtg tgttacatga agtgaaaatt aattctttct gcccttcagt tctttatcct   2700
gataccattt aacactgtct gaattaacta gactgcaata attctttctt ttgaaagctt   2760
ttaaaggata atgtgcaatt cacattaaaa ttgattttcc attgtcaatt agttatactc   2820
attttcctgc cttgatcttt cattagatat tttgtatctg cttggaatat attatcttct   2880
ttttaactgt gtaattggta attactaaaa ctctgtaatc tccaaaatat tgctatcaaa   2940
ttacacacca tgttttctat cattctcata gatctgcctt ataaacattt aaataaaaag   3000
tactatttaa tgatttaaaa aaaaaaaaaa aaaaaaaaa a                         3041
```

TABLE LIII(a)

Nucleotide sequence alignment of
98P4B6 v.1 (SEQ ID NO: 154) and 98P4B6 v.2 (SEQ ID NO: 155)
Score = 1429 bits (743), Expect =
0.0 Identities = 750/751 (99%), Gaps = 1/751 (0%) Strand Plus/Plus

```
V.1:   1687  gatcttttgcagctttgcagatacccagactgagctggaactggaatttgtcttcctatt   1746
             ||||||||||||||||||||||||||||||||||||||||||||||||||||||||||||
V.2:   2291  gatcttttgcagctttgcagatacccagactgagctggaactggaatttgtcttcctatt   2350

V.1:   1747  gactctacttctttaaaagcggctgcccattacattcctcagctgtccttgcagttaggt   1806
             ||||||||||||||||||||||||||||||||||||||||||||||||||||||||||||
V.2:   2351  gactctacttctttaaaagcggctgcccattacattcctcagctgtccttgcagttaggt   2410

V.1:   1807  gtacatgtgactgagtgttggccagtgagatgaagtctcctcaaaggaaggcagcatgtg   1866
             ||||||||||||||||||||||||||||||||||||||||||||||||||||||||||||
V.2:   2411  gtacatgtgactgagtgttggccagtgagatgaagtctcctcaaaggaaggcagcatgtg   2470

V.1:   1867  tccttttcatcccttcatcttgctgctgggattgtggatataacaggagccctggcagc   1926
             ||||||||||||||||||||||||||||||||||||||||||||||||||||||||||||
V.2:   2471  tccttttcatcccttcatcttgctgctgggattgtggatataacaggagccctggcagc   2530

V.1:   1927  tgtctccagaggatcaaagccacacccaaagagtaaggcagattagagaccagaaagacc   1986
             ||||||||||||||||||||||||||||||||||||||||||||||||||||||||||||
V.2:   2531  tgtctccagaggatcaaagccacacccaaagagtaaggcagattagagaccagaaagacc   2590

V.1:   1987  ttgactacttccctacttccactgctttt-cctgcatttaagccattgtaaatctgggtg   2045
             ||||||||||||||||||||||||||||| ||||||||||||||||||||||||||||||
V.2:   2591  ttgactacttccctacttccactgcttttcctgcatttaagccattgtaaatctgggtg   2650

V.1:   2046  tgttacatgaagtgaaaattaattctttctgcccttcagttctttatcctgataccattt   2105
             ||||||||||||||||||||||||||||||||||||||||||||||||||||||||||||
V.2:   2651  tgttacatgaagtgaaaattaattctttctgcccttcagttctttatcctgataccattt   2710

V.1:   2106  aacactgtctgaattaactagactgcaataattctttcttttgaagcttttaaaggata   2165
             ||||||||||||||||||||||||||||||||||||||||||||||||||||||||||||
V.2:   2711  aacactgtctgaattaactagactgcaataattctttcttttgaagcttttaaaggata   2770

V.1:   2166  atgtgcaattcacattaaaattgattttccattgtcaattagttatactcattttcctgc   2225
             ||||||||||||||||||||||||||||||||||||||||||||||||||||||||||||
v.2:   2771  atgtgcaattcacattaaaattgattttccattgtcaattagttatactcattttcctgc   2830

V.1:   2226  cttgatctttcattagatattttgtatctgcttggaatatattatcttctttttaactgt   2285
             ||||||||||||||||||||||||||||||||||||||||||||||||||||||||||||
v.2:   2831  cttgatctttcattagatattttgtatctgcttggaatatattatcttctttttaactgt   2890
```

TABLE LIII(a)-continued

Nucleotide sequence alignment of
98P4B6 v.1 (SEQ ID NO: 154) and 98P4B6 v.2 (SEQ ID NO: 155)
Score = 1429 bits (743), Expect =
0.0Identities = 750/751 (99%), Gaps = 1/751 (0%) Strand Plus/Plus

```
V.1:  2286  gtaattggtaattactaaaactctgtaatctccaaaatattgctatcaaattacacacca  2345
            ||||||||||||||||||||||||||||||||||||||||||||||||||||||||||||
v.2:  2891  gtaattggtaattactaaaactctgtaatctccaaaatattgctatcaaattacacacca  2950

V.1:  2436  tgttttctatcattctcatagatctgccttataaacatttaaataaaaagtactatttaa  2405
            ||||||||||||||||||||||||||||||||||||||||||||||||||||||||||||
v.2:  2951  tgttttctatcattctcatagatctgccttataaacatttaaataaaaagtactatttaa  3010

V.1:  2406  tgatttaaaaaaaaaaaaaaaaaaaaaaaaa                               2436
            |||||||||||||||||||||||||||||||
v.2:  3011  tgatttaaaaaaaaaaaaaaaaaaaaaaaaa                               3041
```

NOTE:
THERE WAS A SINGLE NUCLEOTIDE INSERTION OF A SINGLE BASE AT 2620 OF V.2.

TABLE LIV(a)

Peptide sequences (partial) of protein coded by 98P4B6
v.2 (SEQ ID NO: 156)

SGSPGLQALS LSLSSGFTPF SCLSLPSSWD YRCPPPCPAD FFLYF         45

TABLE LV(a)

Amino acid sequence alignment of 98P4B6 v.1 and 98P4B6 v.2     30

--NO SIGNIFICANT HOMOLOGY--

TABLE LII(b)

Nucleotide sequence of transcript variant 98P4B6 v.3
(SEQ ID NO: 157)

| | | | | |
|---|---|---|---|---|
| ttctgctata | gagatggaac | agtatatgga | aagctcccaa gaaagtgaag agaggaaatt | 60 |
| ggaaaattgt | gagtggacct | tctgatactg | ctcctccttg cgtggaaaag gggaaagaac | 120 |
| tgcatgcata | ttattcagcg | tcctatattc | aaaggatatt cttggtgatc ttggaagtgt | 180 |
| ccgtatcatg | gaatcaatct | ctatgatggg | aagccctaag agccttagtg aaacttgttt | 240 |
| acctaatggc | ataaatggta | tcaaagatgc | aaggaaggtc actgtaggtg tgattggaag | 300 |
| tggagatttt | gccaaatcct | tgaccattcg | acttattaga tgcggctatc atgtggtcat | 360 |
| aggaagtaga | aatcctaagt | ttgcttctga | attttttcct catgtggtag atgtcactca | 420 |
| tcatgaagat | gctctcacaa | aaacaaatat | aatatttgtt gctatacaca gagaacatta | 480 |
| tacctccctg | tgggacctga | gacatctgct | tgtgggtaaa atcctgattg atgtgagcaa | 540 |
| taacatgagg | ataaaccagt | acccagaatc | caatgctgaa tatttggctt cattattccc | 600 |
| agattctttg | attgtcaaag | gatttaatgt | tgtctcagct tgggcacttc agttaggacc | 660 |
| taaggatgcc | agccggcagg | tttatatatg | cagcaacaat attcaagcgc gacaacaggt | 720 |
| tattgaactt | gcccgccagt | tgaatttcat | tcccattgac ttgggatcct tatcatcagc | 780 |
| cagagagatt | gaaaatttac | ccctacgact | ctttactctc tggagagggc cagtggtggt | 840 |
| agctataagc | ttggccacat | tttttttcct | ttattccttt gtcagagatg tgattcatcc | 900 |
| atatgctaga | aaccaacaga | gtgactttta | caaaattcct atagagattg tgaataaaac | 960 |
| cttacctata | gttgccatta | ctttgctctc | cctagtatac cttgcaggtc ttctggcagc | 1020 |

TABLE LII(b)-continued

Nucleotide sequence of transcript variant 98P4B6 v.3
(SEQ ID NO: 157)

```
tgcttatcaa ctttattacg gcaccaagta taggagattt ccaccttggt tggaaacctg    1080
gttacagtgt agaaaacagc ttggattact aagttttttc ttcgctatgg tccatgttgc    1140
ctacagcctc tgcttaccga tgagaaggtc agagagatat ttgtttctca acatggctta    1200
tcagcaggtt catgcaaata ttgaaaactc ttggaatgag gaagaagttt ggagaattga    1260
aatgtatatc tcctttggca taatgagcct tggcttactt tccctcctgg cagtcacttc    1320
tatcccttca gtgagcaatg ctttaaactg gagagaattc agttttattc agtctacact    1380
tggatatgtc gctctgctca taagtacttt ccatgtttta atttatggat ggaaacgagc    1440
ttttgaggaa gagtactaca gattttatac accaccaaac tttgttcttg ctcttgtttt    1500
gccctcaatt gtaattctgg atcttttgca gctttgcaga tacccagact gagctggaac    1560
tggaatttgt cttcctattg actctacttc tttaaaagcg gctgcccatt acattcctca    1620
gctgtccttg cagttaggtg tacatgtgac tgagtgttgg ccagtgagat gaagtctcct    1680
caaaggaagg cagcatgtgt cctttttcat cccttcatct tgctgctggg attgtggata    1740
taacaggagc cctggcagct gtctccagag gatcaaagcc acacccaaag agtaaggcag    1800
attagagacc agaaagacct tgactacttc cctacttcca ctgctttttc ctgcatttaa    1860
gccattgtaa atctgggtgt gttacatgaa gtgaaaatta attctttctg cccttcagtt    1920
ctttatcctg ataccattta acactgtctg aattaactag actgcaataa ttctttcttt    1980
tgaaagcttt taaaggataa tgtgcaattc acattaaaat tgattttcca ttgtcaatta    2040
gttatactca ttttcctgcc ttgatctttc attagatatt ttgtatctgc ttggaatata    2100
ttatcttctt tttaactgtg taattggtaa ttactaaaac tctgtaatct ccaaaatatt    2160
gctatcaaat tacacaccat gttttctatc attctcatag atctgcctta taaacattta    2220
aataaaaagt actatttaat gatttaactt ctgttttgaa aaaaaaaaa aaaaaaaaa     2280
```

TABLE LIII(b)

Nucleotide sequence alignment of
98P4B6 v.1 (SEQ ID NO: 158) and 98P4B6 v.3 (SEQ ID NO: 159)
Score = 4013 bits (2087), Expect =
0.0Identities = 2116/2128 (99%), Gaps = 1/2128 (0%) Strand = Plus/Plus

```
V.1:  320 aggatattcttggtgatcttggaagtgtccgtatcatggaatcaatctctatgatgggaa  379
          ||||||||||||||||||||||||||||||||||||||||||||||||||||||||||||
v.3:  153 aggatattcttggtgatcttggaagtgtccgtatcatggaatcaatctctatgatgggaa  212

V.1:  380 gccctaagagccttagtgaaacttgtttacctaatggcataaatggtatcaaagatgcaa  439
          ||||||||||||||||||||||||||||||||||||||||||||||||||||||||||||
v.3:  213 gccctaagagccttagtgaaacttgtttacctaatggcataaatggtatcaaagatgcaa  272

V.1:  440 ggaaggtcactgtaggtgtgattggaagtggagattttgccaaatccttgaccattcgac  499
          ||||||||||||||||||||||||||||||||||||||||||||||||||||||||||||
v.3:  273 ggaaggtcactgtaggtgtgattggaagtggagattttgccaaatccttgaccattcgac  332

V.1:  500 ttattagatgcggctatcatgtggtcataggaagtagaaatcctaagtttgcttctgaat  559
          ||||||||||||||||||||||||||||||||||||||||||||||||||||||||||||
v.3:  333 ttattagatgcggctatcatgtggtcataggaagtagaaatcctaagtttgcttctgaat  392

V.1:  560 tttttcctcatgtggtagatgtcactcatcatgaagatgctctcacaaaaacaaatataa  619
          ||||||||||||||||||||||||||||||||||||||||||||||||||||||||||||
v.3:  393 tttttcctcatgtggtagatgtcactcatcatgaagatgctctcacaaaaacaaatataa  452

V.1:  620 tatttgttgctatacacagagaacattatacctccctgtgggacctgagacatctgcttg  679
          ||||||||||||||||||||||||||||||||||||||||||||||||||||||||||||
v.3:  453 tatttgttgctatacacagagaacattatacctccctgtgggacctgagacatctgcttg  512
```

TABLE LIII(b)-continued

Nucleotide sequence alignment of
98P4B6 v.1 (SEQ ID NO: 158) and 98P4B6 v.3 (SEQ ID NO: 159)
Score = 4013 bits (2087), Expect =
0.0Identities = 2116/2128 (99%), Gaps = 1/2128 (0%) Strand = Plus/Plus

```
V.1:   680  tgggtaaaatcctgattgatgtgagcaataacatgaggataaaccagtacccagaatcca   739
            ||||||||||||||||||||||||||||||||||||||||||||||||||||||||||||
v.3:   513  tgggtaaaatcctgattgatgtgagcaataacatgaggataaaccagtacccagaatcca   572

V.1:   740  atgctgaatattcggcttcattattcccagattctttgattgtcaaaggatttaatgttg   799
            ||||||||||||||||||||||||||||||||||||||||||||||||||||||||||||
v.3:   573  atgctgaatattcggcttcattattcccagattctttgattgtcaaaggatttaatgttg   632

V.1:   800  tctcagcttgggcacttcagttaggacctaaggatgccagccggcaggtttatatatgca   859
            ||||||||||||||||||||||||||||||||||||||||||||||||||||||||||||
v.3:   633  tctcagcttgggcacttcagttaggacctaaggatgccagccggcaggtttatatatgca   692

V.1:   860  gcaacaatattcaagcgcgacaacaggttattgaacttgcccgccagttgaatttcattc   919
            ||||||||||||||||||||||||||||||||||||||||||||||||||||||||||||
v.3:   693  gcaacaatattcaagcgcgacaacaggttattgaacttgcccgccagttgaatttcattc   752

V.1:   920  ccattgacttgggatccttatcatcagccagagagattgaaaatttacccctacgactct   979
            ||||||||||||||||||||||||||||||||||||||||||||||||||||||||||||
V.3:   753  ccattgacttgggatccttatcatcagccagagagattgaaaatttacccctacgactct   812

V.1:   980  ttactctctggagagggccagtggtggtagctataagcttggccacatttttttttccttt   1039
            ||||||||||||||||||||||||||||||||||||||||||||||||||||||||||||
V.3:   813  ttactctctggagagggccagtggtggtagctataagcttggccacatttttttttccttt   872

V.1:  1040  attcctttgtcagagatgtgattcatccatatgctagaaaccaacagagtgacttttaca   1099
            ||||||||||||||||||||||||||||||||||||||||||||||||||||||||||||
V.3:   873  attcctttgtcagagatgtgattcatccatatgctagaaaccaacagagtgacttttaca   932

V.1:  1100  aaattcctatagagattgtgaataaaaaccttacctatagttgccattactttgctctccc   1159
            ||||||||||||||||||||||||||||||||||||||||||||||||||||||||||||
V.3:   933  aaattcctatagagattgtgaataaaaaccttacctatagttgccattactttgctctccc   992

V.1:  1160  tagtataccttgcaggtcttctggcagctgcttatcaactttattacggcaccaagtata   1219
            ||||||||||||||||||||||||||||||||||||||||||||||||||||||||||||
V.3:   993  tagtataccttgcaggtcttctggcagctgcttatcaactttattacggcaccaagtata   1052

V.1:  1220  ggagatttccaccttggttggaaacctggttacagtgtagaaaacagcttggattactaa   1279
            ||||||||||||||||||||||||||||||||||||||||||||||||||||||||||||
V.3:  1053  ggagatttccaccttggttggaaacctggttacagtgtagaaaacagcttggattactaa   1112

V.1:  1280  gttttttcttcgctatggtccatgttgcctacagcctctgcttaccgatgagaaggtcag   1339
            ||||||||||||||||||||||||||||||||||||||||||||||||||||||||||||
V.3:  1113  ggagatttccaccttggttggaaacctggttacagtgtagaaaacagcttggattactaa   1172

V.1:  1340  agagatatttgtttctcaacatggcttatcagcaggttcatgcaaatattgaaaactctt   1399
            ||||||||||||||||||||||||||||||||||||||||||||||||||||||||||||
V.3:  1173  agagatatttgtttctcaacatggcttatcagcaggttcatgcaaatattgaaaactctt   1232

V.1:  1400  ggaatgaggaagaagtttggagaattgaaatgtatatctcctttggcataatgagccttg   1459
            ||||||||||||||||||||||||||||||||||||||||||||||||||||||||||||
V.3:  1233  agagatatttgtttctcaacatggcttatcagcaggttcatgcaaatattgaaaactctt   1292

V.1:  1460  gcttactttccctcctggcagtcacttctatcccttcagtgagcaatgctttaaactgga   1519
            ||||||||||||||||||||||||||||||||||||||||||||||||||||||||||||
V.3:  1293  gcttactttccctcctggcagtcacttctatcccttcagtgagcaatgctttaaactgga   1352

V.1:  1520  gagaattcagttttattcagtctacacttggatatgtcgctctgctcataagtactttcc   1579
            ||||||||||||||||||||||||||||||||||||||||||||||||||||||||||||
V.3:  1353  gagaattcagttttattcagtctacacttggatatgtcgctctgctcataagtactttcc   1412

V.1:  1580  atgttttaatttatggatggaaacgagcttttgaggaagagtactacagattttatacac   1639
            ||||||||||||||||||||||||||||||||||||||||||||||||||||||||||||
V.3:  1413  atgttttaatttatggatggaaacgagcttttgaggaagagtactacagattttatacac   1472

V.1:  1640  caccaaactttgttcttgctcttgttttgccctcaattgtaattctggatcttttgcagc   1699
            ||||||||||||||||||||||||||||||||||||||||||||||||||||||||||||
V.3:  1473  caccaaactttgttcttgctcttgttttgccctcaattgtaattctggatcttttgcagc   1532

V.1:  1700  tttgcagatacccagactgagctggaactggaatttgtcttcctattgactctacttctt   1759
            ||||||||||||||||||||||||||||||||||||||||||||||||||||||||||||
V.3:  1533  tttgcagatacccagactgagctggaactggaatttgtcttcctattgactctacttctt   1592
```

TABLE LIII(b)-continued

Nucleotide sequence alignment of
98P4B6 v.1 (SEQ ID NO: 158) and 98P4B6 v.3 (SEQ ID NO: 159)
Score = 4013 bits (2087), Expect =
0.0 Identities = 2116/2128 (99%), Gaps = 1/2128 (0%) Strand = Plus/Plus

```
V.1:  1760  taaaagcggctgcccattacattcctcagctgtccttgcagttaggtgtacatgtgactg  1819
            ||||||||||||||||||||||||||||||||||||||||||||||||||||||||||||
V.3:  1593  taaaagcggctgcccattacattcctcagctgtccttgcagttaggtgtacatgtgactg  1652 v.1:  1820  agtgttggccagtgagatgaagtctcctcaaaggaaggcagcatgtgtccttttcatcc   1879
            ||||||||||||||||||||||||||||||||||||||||||||||||||||||||||||
v.3:  1653  agtgttggccagtgagatgaagtctcctcaaaggaaggcagcatgtgtccttttcatcc   1712 v.1:  1880  cttcatcttgctgctgggattgtggatataacaggagccctggcagctgtctccagagga  1939
            ||||||||||||||||||||||||||||||||||||||||||||||||||||||||||||
v.3:  1713  cttcatcttgctgctgggattgtggatataacaggagccctggcagctgtctccagagga  1772 v.1:  1940  tcaaagccacacccaaagagtaaggcagattagagaccagaaagaccttgactacttccc  1999
            ||||||||||||||||||||||||||||||||||||||||||||||||||||||||||||
v.3:  1773  tcaaagccacacccaaagagtaaggcagattagagaccagaaagaccttgactacttccc  1832 v.1:  2000  tacttccactgctttt-cctgcatttaagccattgtaaatctgggtgtgttacatgaagt  2058
            ||||||||||||||||  ||||||||||||||||||||||||||||||||||||||||||
v.3:  1833  tacttccactgcttttt cctgcatttaagccattgtaaatctgggtgtgttacatgaagt  1892 v.1:  2059  gaaaattaattctttctgcccttcagttctttatcctgataccatttaacactgtctgaa  2118
            ||||||||||||||||||||||||||||||||||||||||||||||||||||||||||||
v.3:  1893  gaaaattaattctttctgcccttcagttctttatcctgataccatttaacactgtctgaa  1952 v.1:  2119  ttaactagactgcaataattctttcttttgaaagcttttaaaggataatgtgcaattcac  2178
            ||||||||||||||||||||||||||||||||||||||||||||||||||||||||||||
v.3:  1953  ttaactagactgcaataattctttcttttgaaagcttttaaaggataatgtgcaattcac  2012 v.1:  2179  attaaaattgattttccattgtcaattagttatactcattttcctgccttgatctttcat  2238
            ||||||||||||||||||||||||||||||||||||||||||||||||||||||||||||
v.3:  2013  attaaaattgattttccattgtcaattagttatactcattttcctgccttgatctttcat  2072 v.1:  2239  tagatattttgtatctgcttggaatatattatcttcttttaactgtgtaattggtaatt   2298
            ||||||||||||||||||||||||||||||||||||||||||||||||||||||||||||
v.3:  2073  tagatattttgtatctgcttggaatatattatcttcttttaactgtgtaattggtaatt   2132 v.1:  2299  actaaaactctgtaatctccaaaatattgctatcaaattacacaccatgttttctatcat  2358
            ||||||||||||||||||||||||||||||||||||||||||||||||||||||||||||
v.3:  2133  actaaaactctgtaatctccaaaatattgctatcaaattacacaccatgttttctatcat  2192 v.1:  2359  tctcatagatctgccttataaacatttaaataaaaagtactatttaatgatttaaaaaaa  2418
            |||||||||||||||||||||||||||||||||||||||||||||||||||||||||
v.3:  2193  tctcatagatctgccttataaacatttaaataaaaagtactatttaatgatttaacttct  2252 v.1:  2419  aaaaaaaaaaaaaaaaaaaaaaaaaaaa                                  2446
            ||||||||||||||||||||||||||
v.3:  2253  gttttgaaaaaaaaaaaaaaaaaaaaaa                                  2280
```

NOTE:
AN INSERTION OF A SINGLE BASE AT 1845 OF V.3

TABLE LV(b)

| Peptide sequences of protein coded by 98P4B6 v.3 (SEQ ID NO: 160) | |
|---|---|
| MESISMMGSP KSLSETCLPN GINGIKDARK VTVGVIGSGD FAKSLTIRLI RCGYHVVIGS | 60 |
| RNPKFASEFF PHVVDVTHHE DALTKTNIIF VAIHREHYTS LWDLRHLLVG KILIDVSNNM | 120 |
| RINQYPESNA EYLASLFPDS LIVKGFNVVS AWALQLGPKD ASRQVYICSN NIQARQQVIE | 180 |
| LARQLNFIPI DLGSLSSARE IENLPLRLFT LWRGPVVVAI SLATFFFLYS FVRDVIHPYA | 240 |
| RNQQSDFYKI PIEIVNKTLP IVAITLLSLV YLAGLLAAAY QLYYGTKYRR FPPWLETWLQ | 300 |
| CRKQLGLLSF FFAMVHVAYS LCLPMRRSER YLFLNMAYQQ VHANIENSWN EEEVWRIEMY | 360 |
| ISFGIMSLGL LSLLAVTSIP SVSNALNWRE FSFIQSTLGY VALLISTFHV LIYGWKRAFE | 420 |
| EEYYRFYTPP NFVLALVLPS IVILDLLQLC RYPD | 454 |

TABLE LV(b)

Amino acid sequence alignment of 98P4B6 v.1 (SEQ ID NO: 161) and
98P4B6 v.3 (SEQ ID NO: 162)
Score = 910 bits (2351), Expect = 0.0 Identities = 454/454 (100%),
Positives = 454/454 (100%)

```
V.1:   1 MESISMMGSPKSLSETCLPNGINGIKDARKVTVGVIGSGDFAKSLTIRLIRCGYHVVIGS  60
         MESISMMGSPKSLSETCLPNGINGIKDARKVTVGVIGSGDFAKSLTIRLIRCGYHVVIGS
V.3:   1 MESISMMGSPKSLSETCLPNGINGIKDARKVTVGVIGSGDFAKSLTIRLIRCGYHVVIGS  60

V.1:  61 RNPKFASEFFPHVVDVTHHEDALTKTNIIFVAIHREHYTSLWDLRHLLVGKILIDVSNNM 120
         RNPKFASEFFPHVVDVTHHEDALTKTNIIFVAIHREHYTSLWDLRHLLVGKILIDVSNNM
V.3:  61 RNPKFASEFFPHVVDVTHHEDALTKTNIIFVAIHREHYTSLWDLRHLLVGKILIDVSNNM 120

V.1: 121 RINQYPESNAEYLASLFPDSLIVKGFNVVSAWALQLGPKDASRQVYICSNNIQARQQVIE 180
         RINQYPESNAEYLASLFPDSLIVKGFNVVSAWALQLGPKDASRQVYICSNNIQARQQVIE
V.3: 121 RINQYPESNAEYLASLFPDSLIVKGFNVVSAWALQLGPKDASRQVYICSNNIQARQQVIE 180

V.1: 181 LARQLNFIPIDLGSLSSAREIENLPLRLFTLWRGPVVVAISLATFFFLYSFVRDVIHPYA 240
         LARQLNFIPIDLGSLSSAREIENLPLRLFTLWRGPVVVAISLATFFFLYSFVRDVIHPYA
V.3: 181 LARQLNFIPIDLGSLSSAREIENLPLRLFTLWRGPVVVAISLATFFFLYSFVRDVIHPYA 240

V.1: 241 RNQQSDFYKIPIEIVNKTLPIVAITLLSLVYLAGLLAAAYQLYYGTKYRRFPPWLETWLQ 300
         RNQQSDFYKIPIEIVNKTLPIVAITLLSLVYLAGLLAAAYQLYYGTKYRRFPPWLETWLQ
V.3: 241 RNQQSDFYKIPIEIVNKTLPIVAITLLSLVYLAGLLAAAYQLYYGTKYRRFPPWLETWLQ 300

V.1: 301 CRKQLGLLSFFFAMVHVAYSLCLPMRRSERYLFLNMAYQQVHANIENSWNEEEVWRIEMY 360
         CRKQLGLLSFFFAMVHVAYSLCLPMRRSERYLFLNMAYQQVHANIENSWNEEEVWRIEMY
V.3: 301 CRKQLGLLSFFFAMVHVAYSLCLPMRRSERYLFLNMAYQQVHANIENSWNEEEVWRIEMY 360

V.1: 361 ISFGIMSLGLLSLLAVTSIPSVSNALNWREFSFIQSTLGYVALLISTFHVLIYGWKRAFE 420
         ISFGIMSLGLLSLLAVTSIPSVSNALNWREFSFIQSTLGYVALLISTFHVLIYGWKRAFE
V.3: 361 ISFGIMSLGLLSLLAVTSIPSVSNALNWREFSFIQSTLGYVALLISTFHVLIYGWKRAFE 420

V.1: 421 EEYYRFYTPPNFVLALVLPSIVILDLLQLCRYPD                           454
         EEYYRFYTPPNFVLALVLPSIVILDLLQLCRYPD
V.3: 421 EEYYRFYTPPNFVLALVLPSIVILDLLQLCRYPD                           454
```

TABLE LII(c)

Nucleotide sequence of transcript variant 98P4B6 v.4
(SEQ ID NO: 163)

| | | | | |
|---|---|---|---|---|
| cccacgcgtc | cgcggacgcg | tgggcggacg | cgtgggttcc | tcgggccctc ggcgccacaa | 60 |
| gctgtccggg | cacgcagccc | ctagcggcgc | gtcgctgcca | agccggcctc cgcgcgcctc | 120 |
| cctccttcct | tctcccctgg | ctgttcgcga | tccagcttgg | gtaggcgggg aagcagctgg | 180 |
| agtgcgaccg | ccacggcagc | caccctgcaa | ccgccagtcg | agagctaag ggcaagtcct | 240 |
| gaggttgggc | ccaggagaaa | gaaggcaagg | agacattgtc | ccaggatatt cttggtgatc | 300 |
| ttggaagtgt | ccgtatcatg | gaatcaatct | ctatgatggg | aagccctaag agccttagtg | 360 |
| aaacttgttt | acctaatggc | ataaatggta | tcaaagatgc | aaggaaggtc actgtaggtg | 420 |
| tgattggaag | tggagatttt | gccaaatcct | tgaccattcg | acttattaga tgcggctatc | 480 |
| atgtggtcat | aggaagtaga | aatcctaagt | ttgcttctga | attttttcct catgtggtag | 540 |
| atgtcactca | tcatgaagat | gctctcacaa | aaacaaatat | aatatttgtt gctatacaca | 600 |
| gagaacatta | tacctccctg | tgggacctga | gacatctgct | tgtgggtaaa atcctgattg | 660 |
| atgtgagcaa | taacatgagg | ataaaccagt | acccagaatc | caatgctgaa tatttggctt | 720 |
| cattattccc | agattctttg | attgtcaaag | gatttaatgt | tgtctcagct tgggcacttc | 780 |
| agttaggacc | taaggatgcc | agccggcagg | tttatatatg | cagcaacaat attcaagcgc | 840 |
| gacaacaggt | tattgaactt | gcccgccagt | tgaatttcat | tcccattgac ttgggatcct | 900 |
| tatcatcagc | cagagagatt | gaaaatttac | ccctacgact | ctttactctc tggagagggc | 960 |
| cagtggtggt | agctataagc | ttggccacat | tttttttcct | ttattccttt gtcagagatg | 1020 |

TABLE LII(c)-continued

Nucleotide sequence of transcript variant 98P4B6 v.4
(SEQ ID NO: 163)

```
tgattcatcc atatgctaga aaccaacaga gtgacttta caaaattcct atagagattg    1080
tgaataaaac cttacctata gttgccatta ctttgctctc cctagtatac cttgcaggtc    1140
ttctggcagc tgcttatcaa ctttattacg gcaccaagta taggagattt ccaccttggt    1200
tggaaacctg gttacagtgt agaaaacagc ttggattact aagttttttc ttcgctatgg    1260
tccatgttgc ctacagcctc tgcttaccga tgagaaggtc agagagatat ttgtttctca    1320
acatggctta tcagcaggtt catgcaaata ttgaaaactc ttggaatgag gaagaagttt    1380
ggagaattga aatgtatatc tcctttggca taatgagcct tggcttactt tccctcctgg    1440
cagtcacttc tatcccttca gtgagcaatg ctttaaactg gagagaattc agttttattc    1500
agtctacact tggatatgtc gctctgctca taagtacttt ccatgtttta atttatggat    1560
ggaaacgagc ttttgaggaa gagtactaca gattttatac accaccaaac tttgttcttg    1620
ctcttgtttt gccctcaatt gtaattctgg atcttttgca gctttgcaga tacccagact    1680
gagctggaac tggaatttgt cttcctattg actctacttc tttaaaagcg gctgcccatt    1740
acattcctca gctgtccttg cagttaggtg tacatgtgac tgagtgttgg ccagtgagat    1800
gaagtctcct caaaggaagg cagcatgtgt cctttttcat cccttcatct tgctgctggg    1860
attgtggata taacaggagc cctggcagct gtctccagag gatcaaagcc acccccaaag    1920
agtaaggcag attagagacc agaaagacct tgactacttc cctacttcca ctgcttttcc    1980
tgcatttaag ccattgtaaa tctgggtgtg ttacatgaag tgaaaattaa ttctttctgc    2040
ccttcagttc tttatcctga taccatttaa cactgtctga attaactaga ctgcaataat    2100
tctttctttt gaaagctttt aaaggataat gtgcaattca cattaaaatt gattttccat    2160
tgtcaattag ttatactcat tttcctgcct tgatctttca ttagatattt tgtatctgct    2220
tggaatatat tatcttcttt ttaactgtgt aattggtaat tactaaaact ctgtaatctc    2280
caaaatattg ctatcaaatt acacaccatg tttctatca ttctcataga tctgccttat    2340
aaacatttaa ataaaaagta ctatttaatg attt                                2374
```

TABLE LIII(c)

Nucleotide sequence alignment of
98P4B6 v.1 (SEQ ID NO: 164) and 98P4B6 v.4 (SEQ ID NO: 165)

Score = 404 bits (210), Expect =
e-109Identities = 210/210 (100%) Strand = Plus/Plus

```
v.1:     1 ggacgcgtgggcggacgcgtgggttcctcgggccctcggcgccacaagctgtccgggcac    60
           ||||||||||||||||||||||||||||||||||||||||||||||||||||||||||||
v.4:    14 ggacgcgtgggcggacgcgtgggttcctcgggccctcggcgccacaagctgtccgggcac    73 v.1:    61 gcagcccctagcggcgcgtcgctgccaagccggcctccgcgcgcctcctccttccttct   120
           ||||||||||||||||||||||||||||||||||||||||||||||||||||||||||||
v.4:    74 gcagcccctagcggcgcgtcgctgccaagccggcctccgcgcgcctcctccttccttct   133 v.1:   121 cccctggctgttcgcgatccagcttgggtaggcggggaagcagctggagtgcgaccgcca   180
           ||||||||||||||||||||||||||||||||||||||||||||||||||||||||||||
v.4:   134 cccctggctgttcgcgatccagcttgggtaggcggggaagcagctggagtgcgaccgcca   193 v.1:   181 cggcagccaccctgcaaccgccagtcggag                                210
           ||||||||||||||||||||||||||||||
v.4:   194 cggcagccaccctgcaaccgccagtcggag                                223
```

Score = 4022 bits (2092), Expect =
0.0Identities = 2092/2092 (100%) Strand = Plus/Plus

TABLE LIII(c)-continued

Nucleotide sequence alignment of
98P4B6 v.1 (SEQ ID NO: 164) and 98P4B6 v.4 (SEQ ID NO: 165)

```
v.1:   320  aggatattcttggtgatcttggaagtgtccgtatcatggaatcaatctctatgatgggaa  379
            ||||||||||||||||||||||||||||||||||||||||||||||||||||||||||||
v.4:   283  aggatattcttggtgatcttggaagtgtccgtatcatggaatcaatctctatgatgggaa  342 v.1:   380  gccctaagagccttagtgaaacttgtttacctaatggcataaatggtatcaaagatgcaa  439
            ||||||||||||||||||||||||||||||||||||||||||||||||||||||||||||
v.4:   343  gccctaagagccttagtgaaacttgtttacctaatggcataaatggtatcaaagatgcaa  402 v.1:   440  ggaaggtcactgtaggtgtgattggaagtggagattttgccaaatccttgaccattcgac  499
            ||||||||||||||||||||||||||||||||||||||||||||||||||||||||||||
v.4:   403  ggaaggtcactgtaggtgtgattggaagtggagattttgccaaatccttgaccattcgac  462 v.1:   500  ttattagatgcggctatcatgtggtcataggaagtagaaatcctaagtttgcttctgaat  559
            ||||||||||||||||||||||||||||||||||||||||||||||||||||||||||||
v.4:   463  ttattagatgcggctatcatgtggtcataggaagtagaaatcctaagtttgcttctgaat  522 v.1:   560  tttttcctcatgtggtagatgtcactcatcatgaagatgctctcacaaaaacaaatataa  619
            ||||||||||||||||||||||||||||||||||||||||||||||||||||||||||||
v.4:   523  tttttcctcatgtggtagatgtcactcatcatgaagatgctctcacaaaaacaaatataa  582 v.1:   620  tatttgttgctatacacagagaacattatacctccctgtgggacctgagacatctgcttg  679
            ||||||||||||||||||||||||||||||||||||||||||||||||||||||||||||
v.4:   583  tatttgttgctatacacagagaacattatacctccctgtgggacctgagacatctgcttg  642 v.1:   680  tgggtaaaatcctgattgatgtgagcaataacatgaggataaaccagtacccagaatcca  739
            ||||||||||||||||||||||||||||||||||||||||||||||||||||||||||||
v.4:   643  tgggtaaaatcctgattgatgtgagcaataacatgaggataaaccagtacccagaatcca  702 v.1:   740  atgctgaatatttggcttcattattcccagattctttgattgtcaaaggatttaatgttg  799
            ||||||||||||||||||||||||||||||||||||||||||||||||||||||||||||
v.4:   703  atgctgaatatttggcttcattattcccagattctttgattgtcaaaggatttaatgttg  762 v.1:   800  tctcagcttgggcacttcagttaggacctaaggatgccagccggcaggtttatatatgca  859
            ||||||||||||||||||||||||||||||||||||||||||||||||||||||||||||
v.4:   763  tctcagcttgggcacttcagttaggacctaaggatgccagccggcaggtttatatatgca  822 v.1:   860  gcaacaatattcaagcgcgacaacaggttattgaacttgcccgccagttgaatttcattc  919
            ||||||||||||||||||||||||||||||||||||||||||||||||||||||||||||
v.4:   823  gcaacaatattcaagcgcgacaacaggttattgaacttgcccgccagttgaatttcattc  882 v.1:   920  ccattgacttgggatccttatcatcagccagagagattgaaaatttacccctacgactct  979
            ||||||||||||||||||||||||||||||||||||||||||||||||||||||||||||
v.4:   883  ccattgacttgggatccttatcatcagccagagagattgaaaatttacccctacgactct  942 v.1:   980  ttactctctggagagggccagtggtggtagctataagcttggccacatttttttttcctt  1039
            ||||||||||||||||||||||||||||||||||||||||||||||||||||||||||||
v.4:   843  ttactctctggagagggccagtggtggtagctataagcttggccacatttttttttcctt  1002 v.1:  1040  attcctttgtcagagatgtgattcatccatatgctagaaaccaacagagtgacttttaca  1099
            ||||||||||||||||||||||||||||||||||||||||||||||||||||||||||||
v.4:  1003  attcctttgtcagagatgtgattcatccatatgctagaaaccaacagagtgacttttaca  1062 v.1:  1100  aaattcctatagagattgtgaataaaaaccttacctatagttgccattactttgctctccc  1159
            ||||||||||||||||||||||||||||||||||||||||||||||||||||||||||||
v.4:  1063  aaattcctatagagattgtgaataaaaaccttacctatagttgccattactttgctctccc  1122 v.1:  1160  tagtataccttgcaggtcttctggcagctgcttatcaactttattacggcaccaagtata  1219
            ||||||||||||||||||||||||||||||||||||||||||||||||||||||||||||
v.4:  1063  tagtataccttgcaggtcttctggcagctgcttatcaactttattacggcaccaagtata  1182 v.1:  1220  ggagatttccaccttggttggaaacctggttacagtgtagaaaacagcttggattactaa  1279
            ||||||||||||||||||||||||||||||||||||||||||||||||||||||||||||
v.4:  1183  ggagatttccaccttggttggaaacctggttacagtgtagaaaacagcttggattactaa  1242 v.1:  1280  gttttttcttcgctatggtccatgttgcctacagcctctgcttaccgatgagaaggtcag  1339
            ||||||||||||||||||||||||||||||||||||||||||||||||||||||||||||
v.4:  1243  gttttttcttcgctatggtccatgttgcctacagcctctgcttaccgatgagaaggtcag  1302 v.1:  1340  agagatatttgtttctcaacatggcttatcagcaggttcatgcaaatattgaaaactctt  1399
            ||||||||||||||||||||||||||||||||||||||||||||||||||||||||||||
v.4:  1303  agagatatttgtttctcaacatggcttatcagcaggttcatgcaaatattgaaaactctt  1362 v.1:  1400  ggaatgaggaagaagtttggagaattgaaatgtatatctcctttggcataatgagccttg  1459
            ||||||||||||||||||||||||||||||||||||||||||||||||||||||||||||
v.4:  1363  ggaatgaggaagaagtttggagaattgaaatgtatatctcctttggcataatgagccttg  1422
```

TABLE LIII(c)-continued

Nucleotide sequence alignment of
98P4B6 v.1 (SEQ ID NO: 164) and 98P4B6 v.4 (SEQ ID NO: 165)

```
v.1:  1460  gcttactttccctcctggcagtcacttctatcccttcagtgagcaatgctttaaactgga  1519
            ||||||||||||||||||||||||||||||||||||||||||||||||||||||||||||
v.4:  1423  ggaatgaggaagaagtttggagaattgaaatgtatatctcctttggcataatgagccttg  1482 v.1:  1520  gagaattcagttttattcagtctacacttggatatgtcgctctgctcataagtactttcc  1579
            ||||||||||||||||||||||||||||||||||||||||||||||||||||||||||||
v.4:  1483  gagaattcagttttattcagtctacacttggatatgtcgctctgctcataagtactttcc  1542 v.1:  1580  atgttttaatttatggatggaaacgagcttttgaggaagagtactacagattttatacac  1639
            ||||||||||||||||||||||||||||||||||||||||||||||||||||||||||||
v.4:  1543  atgttttaatttatggatggaaacgagcttttgaggaagagtactacagattttatacac  1602 v.1:  1640  caccaaactttgttcttgctcttgttttgccctcaattgtaattctggatcttttgcagc  1699
            ||||||||||||||||||||||||||||||||||||||||||||||||||||||||||||
v.4:  1603  caccaaactttgttcttgctcttgttttgccctcaattgtaattctggatcttttgcagc  1662 v.1:  1700  tttgcagatacccagactgagctggaactggaatttgtcttcctattgactctacttctt  1759
            ||||||||||||||||||||||||||||||||||||||||||||||||||||||||||||
v.4:  1663  tttgcagatacccagactgagctggaactggaatttgtcttcctattgactctacttctt  1722 v.1:  1760  taaaagcggctgcccattacattcctcagctgtccttgcagttaggtgtacatgtgactg  1819
            ||||||||||||||||||||||||||||||||||||||||||||||||||||||||||||
v.4:  1723  taaaagcggctgcccattacattcctcagctgtccttgcagttaggtgtacatgtgactg  1782 v.1:  1820  agtgttggccagtgagatgaagtctcctcaaaggaaggcagcatgtgtccttttcatcc   1879
            ||||||||||||||||||||||||||||||||||||||||||||||||||||||||||||
v.4:  1783  agtgttggccagtgagatgaagtctcctcaaaggaaggcagcatgtgtccttttcatcc   1842 v.1:  1880  cttcatcttgctgctgggattgtggatataacaggagccctggcagctgtctccagagga  1939
            ||||||||||||||||||||||||||||||||||||||||||||||||||||||||||||
v.4:  1843  cttcatcttgctgctgggattgtggatataacaggagccctggcagctgtctccagagga  1902 v.1:  1940  agagatatttgtttctcaacatggcttatcagcaggttcatgcaaatattgaaaactctt  1999
            ||||||||||||||||||||||||||||||||||||||||||||||||||||||||||||
v.4:  1903  agagatatttgtttctcaacatggcttatcagcaggttcatgcaaatattgaaaactctt  1962 v.1:  2000  tacttccactgcttttcctgcatttaagccattgtaaatctgggtgtgttacatgaagtg  2059
            ||||||||||||||||||||||||||||||||||||||||||||||||||||||||||||
v.4:  1963  tacttccactgcttttcctgcatttaagccattgtaaatctgggtgtgttacatgaagtg  2022 v.1:  2060  aaaattaattctttctgcccttcagttctttatcctgataccatttaacactgtctgaat  2119
            ||||||||||||||||||||||||||||||||||||||||||||||||||||||||||||
v.4:  2023  aaaattaattctttctgcccttcagttctttatcctgataccatttaacactgtctgaat  2082

V.1:  2120  taactagactgcaataattctttcttttgaaagcttttaaaggataatgtgcaattcaca  2179
            ||||||||||||||||||||||||||||||||||||||||||||||||||||||||||||
v.4:  2083  taactagactgcaataattctttcttttgaaagcttttaaaggataatgtgcaattcaca  2142

V.1:  2180  ttaaaattgattttccattgtcaattagttatactcattttcctgccttgatctttcatt  2239
            ||||||||||||||||||||||||||||||||||||||||||||||||||||||||||||
v.4:  2143  ttaaaattgattttccattgtcaattagttatactcattttcctgccttgatctttcatt  2202

V.1:  2240  agatattttgtatctgcttggaatatattatcttcttttaactgtgtaattggtaatta   2299
            ||||||||||||||||||||||||||||||||||||||||||||||||||||||||||||
v.4:  2203  agatattttgtatctgcttggaatatattatcttcttttaactgtgtaattggtaatta   2262

V.1:  2300  ctaaaactctgtaatctccaaaatattgctatcaaattacacaccatgttttctatcatt  2359
            ||||||||||||||||||||||||||||||||||||||||||||||||||||||||||||
v.4:  2263  ctaaaactctgtaatctccaaaatattgctatcaaattacacaccatgttttctatcatt  2322

V.1:  2360  ctcatagatctgccttataaacatttaaataaaaagtactatttaatgattt           2411
            ||||||||||||||||||||||||||||||||||||||||||||||||||||
v.4:  2323  ctcatagatctgccttataaacatttaaataaaaagtactatttaatgattt           2374
```

TABLE LIV(c)

Peptide sequences of protein coded by 98P4B6 v.4 (SEQ ID NO: 166)

MESISMMGSP KSLSETCLPN GINGIKDARK VTVGVIGSGD FAKSLTIRLI RCGYNVVIGS   60

RNPKFASEFF PHVVDVTHHE DALTKTNIIF VAIHREHYTS LWDLRHLLVG KILIDVSNNM  120

TABLE LIV(c)-continued

Peptide sequences of protein coded by 98P4B6 v.4 (SEQ ID NO: 166)

```
RINQYPESNA EYLASLFPDS LIVKGFNVVS AWALQLGPKD ASRQVYICSN NIQARQQVIE   180

LARQLNFIPI DLGSLSSARE IENLPLRLFT LWRGPVVVAI SLATFFFLYS FVRDVIHPYA   240

RNQQSDFYKI PIEIVNKTLP IVAITLLSLV YLAGLLAAAY QLYYGTKYRR FPPWLETWLQ   300

CRKQLGLLSF FFAMVHVAYS LCLPMRRSER YLFLNMAYQQ VHANIENSWN EEEVWRIEMY   360

ISFGIMSLGL LSLLAVTSIP SVSNALNWRE FSFIQSTLGY VALLISTFHV LIYGWKRAFE   420

EEYYRFYTPP NFVLALVLPS IVILDLLQLC RYPD                               454
```

TABLE LV(c)

Amino acid sequence alignment of 98P4B6 v.1 (SEQ ID NO: 167) and
98P4B6 v.4 (SEQ ID NO: 168)
Score = 910 bits (2351), Expect = 0.0Identities = 454/454 (100%),
Positives = 454/454 (100%)

```
V.1:   1 MESISMMGSPKSLSETCLPNGINGIKDARKVTVGVIGSGDFAKSLTIRLIRCGYHVVIGS   60
         MESISMMGSPKSLSETCLPNGINGIKDARKVTVGVIGSGDFAKSLTIRLIRCGYHVVIGS
V.4:   1 MESISMMGSPKSLSETCLPNGINGIKDARKVTVGVIGSGDFAKSLTIRLIRCGYHVVIGS   60

V.1:  61 RNPKFASEFFPHVVDVTHHEDALTKTNIIFVAIHREHYTSLWDLRHLLVGKILIDVSNNM  120
         RNPKFASEFFPHVVDVTHHEDALTKTNIIFVAIHREHYTSLWDLRHLLVGKILIDVSNNM
V.4:  61 RNPKFASEFFPHVVDVTHHEDALTKTNIIFVAIHREHYTSLWDLRHLLVGKILIDVSNNM  120

V.1: 121 RINQYPESNAEYLASLFPDSLIVKGFNVVSAWALQLGPKDASRQVYICSNNIQARQQVIE  180
         RINQYPESNAEYLASLFPDSLIVKGFNVVSAWALQLGPKDASRQVYICSNNIQARQQVIE
V.4: 121 RINQYPESNAEYLASLFPDSLIVKGFNVVSAWALQLGPKDASRQVYICSNNIQARQQVIE  180

V.1: 181 LARQLNFIPIDLGSLSSAREIENLPLRLFTLWRGPVVVAISLATFFFLYSFVRDVIHPYA  240
         LARQLNFIPIDLGSLSSAREIENLPLRLFTLWRGPVVVAISLATFFFLYSFVRDVIHPYA
V.4: 181 LARQLNFIPIDLGSLSSAREIENLPLRLFTLWRGPVVVAISLATFFFLYSFVRDVIHPYA  240

V.1: 241 RNQQSDFYKIPIEIVNKTLPIVAITLLSLVYLAGLLAAAYQLYYGTKYRRFPPWLETWLQ  300
         RNQQSDFYKIPIEIVNKTLPIVAITLLSLVYLAGLLAAAYQLYYGTKYRRFPPWLETWLQ
V.4: 241 RNQQSDFYKIPIEIVNKTLPIVAITLLSLVYLAGLLAAAYQLYYGTKYRRFPPWLETWLQ  300

V.1: 301 CRKQLGLLSFFFAMVHVAYSLCLPMRRSERYLFLNMAYQQVHANIENSWNEEEVWRIEMY  360
         CRKQLGLLSFFFAMVHVAYSLCLPMRRSERYLFLNMAYQQVHANIENSWNEEEVWRIEMY
V.4: 301 CRKQLGLLSFFFAMVHVAYSLCLPMRRSERYLFLNMAYQQVHANIENSWNEEEVWRIEMY  360

V.1: 361 ISFGIMSLGLLSLLAVTSIPSVSNALNWREFSFIQSTLGYVALLISTFHVLIYGWKRAFE  420
         ISFGIMSLGLLSLLAVTSIPSVSNALNWREFSFIQSTLGYVALLISTFHVLIYGWKRAFE
V.4: 361 ISFGIMSLGLLSLLAVTSIPSVSNALNWREFSFIQSTLGYVALLISTFHVLIYGWKRAFE  420

V.1: 421 EEYYRFYTPPNFVLALVLPSIVILDLLQLCRYPD                             454
         EEYYRFYTPPNFVLALVLPSIVILDLLQLCRYPD
V.4: 421 EEYYRFYTPPNFVLALVLPSIVILDLLQLCRYPD                             454
```

TABLE LII(d)

Nucleotide sequence of transcript variant 98P4B6 v.5
(SEQ ID NO: 169)

```
cccacgcgtc cgcggacgcg tgggcggacg cgtgggttcc tcgggccctc ggcgccacaa    60
gctgtccggg cacgcagccc ctagcggcgc gtcgctgcca agccggcctc cgcgcgcctc   120
cctccttcct tctcccctgg ctgttcgcga tccagcttgg gtaggcgggg aagcagctgg   180
agtgcgaccg ctacggcagc caccctgcaa ccgccagtcg gagagctaag gcaagtcct    240 gaggttgggc ccaggagaaa gaaggcaagg agacattgtc ccaggatatt cttggtgatc   300
ttggaagtgt ccgtatcatg gaatcaatct ctatgatggg aagccctaag agccttagtg   360
aaacttgttt acctaatggc ataaatggta tcaaagatgc aaggaaggtc actgtaggtg   420
tgattggaag tggagatttt gccaaatcct tgaccattcg acttattaga tgcggctatc   480
```

TABLE LII(d)-continued

Nucleotide sequence of transcript variant 98P4B6 v.5
(SEQ ID NO: 169)

```
atgtggtcat aggaagtaga aatcctaagt ttgcttctga atttttcct catgtggtag      540
atgtcactca tcatgaagat gctctcacaa aaacaaatat aatatttgtt gctatacaca    600
gagaacatta tacctccctg tgggacctga gacatctgct tgtgggtaaa atcctgattg    660
atgtgagcaa taacatgagg ataaaccagt acccagaatc caatgctgaa tatttggctt   720
cattattccc agattctttg attgtcaaag gatttaatgt tgtctcagct tgggcacttc   780
agttaggacc taaggatgcc agccggcagg tttatatatg cagcaacaat attcaagcgc  840
gacaacaggt tattgaactt gcccgccagt tgaatttcat tcccattgac ttgggatcct    900
tatcatcagc cagagagatt gaaaatttac ccctacgact cttttacttt ggagagggc    960
cagtggtggt agctataagc ttggccacat tttttttcct ttattccttt gtcagagatg  1020
tgattcatcc atatgctaga aaccaacaga gtgactttta caaaattcct atagagattg  1080
tgaataaaac cttacctata gttgccatta ctttgctctc cctagtatac cttgcaggtc   1140
ttctggcagc tgcttatcaa ctttattacg gcaccaagta taggagattt ccaccttggt  1200
tggaaacctg gttacagtgt agaaaacagc ttggattact aagttttttc ttcgctatgg 1260
tccatgttgc ctacagcctc tgcttaccga tgagaaggtc agagagatat ttgtttctca  1320
acatggctta tcagcaggtt catgcaaata ttgaaaactc ttggaatgag aagaagttt   1380
ggagaattga aatgtatatc tcctttggca taatgagcct tggcttactt tccctcctgg  1440
cagtcacttc tatcccttcg gtgagcaatg ctttaaactg gagagaattc agttttattc  1500
agatcttttg cagctttgca gatacccaga ctgagctgga actggaattt gtcttcctat   1560
tgactctact tctttaaaag cggctgccca ttacattcct cagctgtcct tgcagttagg  1620
tgtacatgtg actgagtgtt ggccagtgag atgaagtctc ctcaaaggaa ggcagcatgt 1680
gtccttttc atcccttcat cttgctgctg ggattgtgga tataacagga gccctggcag  1740
ctgctccaga ggatcaaagc cacacccaaa gagtaaggca gattagagac cagaaagacc  1800
ttgactactt ccctacttcc actgctttt cctgcattta agccattgta aatctgggtg   1860
tgttacatga agtgaaaatt aattctttct gcccttcagt tctttatcct gataccattt   1920
aacactgtct gaattaacta gactgcaata attcttct ttgaaagctt ttaaaggata  1980
atgtgcaatt cacattaaaa ttgatttttcc attgtcaatt agttatactc attttcctgc 2040
cttgatctt cattagatat tttgtatctg cttggaatat attatcttct tttaactgt    2100
gtaattggta attactaaaa ctctgtaatc tccaaaatat tgctatcaaa ttacacacca 2160
tgttttctat cattctcata gatctgcctt ataaacattt aaataaaaag tactatttac 2220
caaaaaaaaa aaaaaaaaa aaaaaaaaa                                      2249
```

TABLE LIII(d)

Nucleotide sequence alignment of
98P4B6 v.1 (SEQ ID NO: 170) and 98P4B6 v.5 (SEQ ID NO: 171)

Score = 398 bits (207), Expect =
e-107Identities = 209/210 (99%) Strand = Plus/Plus

```
V.1:   1 ggacgcgtgggcggacgcgtgggttcctcgggccctcggcgccacaagctgtccgggcac   60
           ||||||||||||||||||||||||||||||||||||||||||||||||||||||||||||
v.5:  14 ggacgcgtgggcggacgcgtgggttcctcgggccctcggcgccacaagctgtccgggcac   73
```

TABLE LIII(d)-continued

Nucleotide sequence alignment of
98P4B6 v.1 (SEQ ID NO: 170) and 98P4B6 v.5 (SEQ ID NO: 171)

```
V.1:    61  gcagccctagcggcgcgtcgctgccaagccggcctccgcgcgcctccctccttccttct   120
            ||||||||||||||||||||||||||||||||||||||||||||||||||||||||||||
v.5:    74  gcagccctagcggcgcgtcgctgccaagccggcctccgcgcgcctccctccttccttct   133

V.1:   121  cccctggctgttcgcgatccagcttgggtaggcggggaagcagctggagtgcgaccgcca   180
            |||||||||||||||||||||||||||||||||||||||||||||||||||||||||||
v.5:   134  cccctggctgttcgcgatccagcttgggtaggcggggaagcagctggagtgcgaccgcta   193

V.1:   181  cggcagccaccctgcaaccgccagtcggag                               210
            ||||||||||||||||||||||||||||||
v.5:   194  cggcagccaccctgcaaccgccagtcggag                               223
```

Score = 2334 bits (1214), Expect =
0.0Identities = 1218/1220 (99%) Strand = Plus/Plus

```
V.1:   320  aggatattcttggtgatcttggaagtgtccgtatcatggaatcaatctctatgatgggaa   379
            ||||||||||||||||||||||||||||||||||||||||||||||||||||||||||||
v.5:   283  aggatattcttggtgatcttggaagtgtccgtatcatggaatcaatctctatgatgggaa   342

V.1:   380  gccctaagagccttagtgaaacttgtttacctaatggcataaatggtatcaaagatgcaa   439
            ||||||||||||||||||||||||||||||||||||||||||||||||||||||||||||
v.5:   343  gccctaagagccttagtgaaacttgtttacctaatggcataaatggtatcaaagatgcaa   402

V.1:   440  ggaaggtcactgtaggtgtgattggaagtggagattttgccaaatccttgaccattcgac   499
            ||||||||||||||||||||||||||||||||||||||||||||||||||||||||||||
v.5:   403  ggaaggtcactgtaggtgtgattggaagtggagattttgccaaatccttgaccattcgac   462

V.1:   500  ttattagatgcggctatcatgtggtcataggaagtagaaatcctaagtttgcttctgaat   559
            ||||||||||||||||||||||||||||||||||||||||||||||||||||||||||||
v.5:   463  ttattagatgcggctatcatgtggtcataggaagtagaaatcctaagtttgcttctgaat   522

V.1:   560  ttttcctcatgtggtagatgtcactcatcatgaagatgctctcacaaaaacaaatataa   619
            ||||||||||||||||||||||||||||||||||||||||||||||||||||||||||||
v.5:   523  ttttcctcatgtggtagatgtcactcatcatgaagatgctctcacaaaaacaaatataa   582

V.1:   620  tatttgttgctatacacagagaacattataccctcctgtgggacctgagacatctgcttg   679
            ||||||||||||||||||||||||||||||||||||||||||||||||||||||||||||
v.5:   583  tatttgttgctatacacagagaacattataccctcctgtgggacctgagacatctgcttg   642

V.1:   680  tgggtaaaatcctgattgatgtgagcaataacatgaggataaaccagtacccagaatcca   739
            ||||||||||||||||||||||||||||||||||||||||||||||||||||||||||||
v.5:   643  tgggtaaaatcctgattgatgtgagcaataacatgaggataaaccagtacccagaatcca   702

V.1:   740  atgctgaatatttggcttcattattcccagattctttgattgtcaaaggatttaatgttg   799
            ||||||||||||||||||||||||||||||||||||||||||||||||||||||||||||
v.5:   703  atgctgaatatttggcttcattattcccagattctttgattgtcaaaggatttaatgttg   762

V.1:   800  tctcagcttgggcacttcagttaggacctaaggatgccagccggcaggtttatatatgca   859
            ||||||||||||||||||||||||||||||||||||||||||||||||||||||||||||
v.5:   763  tctcagcttgggcacttcagttaggacctaaggatgccagccggcaggtttatatatgca   822

V.1:   860  gcaacaatattcaagcgcgacaacaggttattgaacttgcccgccagttgaatttcattc   919
            ||||||||||||||||||||||||||||||||||||||||||||||||||||||||||||
v.5:   823  gcaacaatattcaagcgcgacaacaggttattgaacttgcccgccagttgaatttcattc   882

V.1:   920  ccattgacttgggatccttatcatcagccagagagattgaaaatttaccccctacgactct   979
            ||||||||||||||||||||||||||||||||||||||||||||||||||||||||||||
v.5:   883  ccattgacttgggatccttatcatcagccagagagattgaaaatttaccccctacgactct   942

V.1:   980  ttactctctggagagggccagtggtggtagctataagcttggccacatttttttcctt   1039
            |||||    |||||||||||||||||||||||||||||||||||||||||||||||||||
v.5:   943  ttactttctggagagggccagtggtggtagctataagcttggccacatttttttcctt   1002

V.1:  1040  attcctttgtcagagatgtgattcatccatatgctagaaaccaacagagtgactttaca   1099
            ||||||||||||||||||||||||||||||||||||||||||||||||||||||||||||
v.5:  1003  attcctttgtcagagatgtgattcatccatatgctagaaaccaacagagtgactttaca   1062

V.1:  1100  aaattcctatagagattgtgaataaaaccttacctatagttgccattactttgctctccc   1159
            ||||||||||||||||||||||||||||||||||||||||||||||||||||||||||||
v.5:  1063  aaattcctatagagattgtgaataaaaccttacctatagttgccattactttgctctccc   1122

V.1:  1160  tagtataccttgcaggtcttctggcagctgcttatcaactttattacggcaccaagtata   1219
            ||||||||||||||||||||||||||||||||||||||||||||||||||||||||||||
v.5:  1123  tagtataccttgcaggtcttctggcagctgcttatcaactttattacggcaccaagtata   1182
```

TABLE LIII(d)-continued

Nucleotide sequence alignment of
98P4B6 v.1 (SEQ ID NO: 170) and 98P4B6 v.5 (SEQ ID NO: 171)

```
V.1:  1220  ggagatttccaccttggttggaaacctggttacagtgtagaaaacagcttggattactaa  1279
            ||||||||||||||||||||||||||||||||||||||||||||||||||||||||||||
v.5:  1183  ggagatttccaccttggttggaaacctggttacagtgtagaaaacagcttggattactaa  1242

V.1:  1280  gttttttcttcgctatggtccatgttgcctacagcctctgcttaccgatgagaaggtcag  1339
            ||||||||||||||||||||||||||||||||||||||||||||||||||||||||||||
v.5:  1243  gttttttcttcgctatggtccatgttgcctacagcctctgcttaccgatgagaaggtcag  1302

V.1:  1340  agagatatttgtttctcaacatggcttatcagcaggttcatgcaaatattgaaaactctt  1399
            ||||||||||||||||||||||||||||||||||||||||||||||||||||||||||||
v.5:  1303  agagatatttgtttctcaacatggcttatcagcaggttcatgcaaatattgaaaactctt  1362

V.1:  1400  ggaatgaggaagaagtttggagaattgaaatgtatatctcctttggcataatgagccttg  1459
            ||||||||||||||||||||||||||||||||||||||||||||||||||||||||||||
v.5:  1363  ggaatgaggaagaagtttggagaattgaaatgtatatctcctttggcataatgagccttg  1422

V.1:  1460  gcttactttccctcctggcagtcacttctatcccttcagtgagcaatgctttaaacgtta  1519
            ||||||||||||||||||||||||||||||||||||||||||||||||||||||||||
v.5:  1423  gcttactttccctcctggcagtcacttctatcccttcggtgagcaatgctttaaactgga  1482

V.1:  1520  gagaattcagtttttattcag                                         1539
            |||||||||||||||||||||
v.5:  1483  gagaattcagtttttattcag                                         1502
```

Score = 1375 bits (715), Expect =
0.0Identities = 741/749 (98%), Gaps = 2/749 (0%) Strand = Plus/Plus

```
v.1:  1687  gatcttttgcagctttgcagatacccagactgagctggaactggaatttgtcttcctatt  1746
            ||||||||||||||||||||||||||||||||||||||||||||||||||||||||||||
v.5:  1502  gatcttttgcagctttgcagatacccagactgagctggaactggaatttgtcttcctatt  1561 v.1:  1747  gactctacttctttaaaagcggctgcccattacattcctcagctgtccttgcagttaggt  1806
            ||||||||||||||||||||||||||||||||||||||||||||||||||||||||||||
v.5:   562  gactctacttctttaaaagcggctgcccattacattcctcagctgtccttgcagttaggt  1621 v.1:  1807  gtacatgtgactgagtgttggccagtgagatgaagtctcctcaaaggaaggcagcatgtg  1866
            ||||||||||||||||||||||||||||||||||||||||||||||||||||||||||||
v.5:  1622  gtacatgtgactgagtgttggccagtgagatgaagtctcctcaaaggaaggcagcatgtg  1681 v.1:  1867  tccttttcatcccttcatcttgctgctgggattgtggatataacaggagccctggcagc  1926
            |  |||||||||||||||||||||||||||||||||||||||||||||||||||||||||
v.5:  1682  tggttttcatcccttcatcttgctgctgggattgtggatataacaggagccctggcagc  1741 v.1:  1927  tgtctccagaggatcaaagccacacccaaagagtaaggcagattagagaccagaaagacc  1986
            || |||||||||||||||||||||||||||||||||||||||||||||||||||||||||
v.5:  1742  tg-ctccagaggatcaaagccacacccaaagagtaaggcagattagagaccagaaagacc  1800 v.1:  1987  ttgactactccctacttccactgctttt-cctgcatttaagccattgtaaatctgggtg  2045
            |||||||||||||||||||||||||||| |||||||||||||||||||||||||||||||
v.5:  1801  ttgactactccctacttccactgcttttcctgcatttaagccattgtaaatctgggtg  1860 v.1:  2046  tgttacatgaagtgaaaattaattctttctgcccttcagttctttatcctgataccattt  2105
            ||||||||||||||||||||||||||||||||||||||||||||||||||||||||||||
v.5:  1861  tgttacatgaagtgaaaattaattctttctgcccttcagttctttatcctgataccattt  1920 v.1:  2106  aacactgtctgaattaactagactgcaataattctttcttttgaaagcttttaaaggata  2165
            ||||||||||||||||||||||||||||||||||||||||||||||||||||||||||||
v.5:  1921  aacactgtctgaattaactagactgcaataattctttcttttgaaagcttttaaaggata  1980 v.1:  2166  atgtgcaattcacattaaaattgattttccattgtcaattagttatactcattttcctgc  2225
            ||||||||||||||||||||||||||||||||||||||||||||||||||||||||||||
v.5:  1981  atgtgcaattcacattaaaattgattttccattgtcaattagttatactcattttcctgc  2040 v.1:  2226  cttgatctttcattagatatttgtatctgcttggaatatattatcttctttttaactgt  2285
            ||||||||||||||||||||||||||||||||||||||||||||||||||||||||||||
v.5:  2041  cttgatctttcattagatatttgtatctgcttggaatatattatcttctttttaactgt  2100 v.1:  2286  gtaattggtaattactaaaactctgtaatctccaaaatattgctatcaaattacacacca  2345
            ||||||||||||||||||||||||||||||||||||||||||||||||||||||||||||
v.5:  2101  gtaattggtaattactaaaactctgtaatctccaaaatattgctatcaaattacacacca  2160 v.1:  2346  tgttttctatcattctcatagatctgccttataaacatttaaataaaagtactatttaa  2405
            ||||||||||||||||||||||||||||||||||||||||||||||||||||||||||||
v.5:  2161  tgttttctatcattctcatagatctgccttataaacatttaaataaaagtactatttac  2220
```

TABLE LIII(d)-continued

Nucleotide sequence alignment of 98P4B6 v.1 (SEQ ID NO: 170) and 98P4B6 v.5 (SEQ ID NO: 171)

```
v.1:  2046  tgatttaaaaaaaaaaaaaaaaaaaaa                          2434
             |||||||||||||||||||||||||||
v.5:  2221  caaaaaaaaaaaaaaaaaaaaaaaaaa                          2249
```

NOTE:
A SNP AT 192 AND AT 1510, A DELETION AT 1742-1743, AND AN INSERTION OF SINGLE BASE AT 1830 OF V.5.

TABLE LIV(d)

Peptide sequences of protein coded by 98P4B6 v.5 (SEQ ID NO: 172)

```
MESISMMGSP KSLSETCLPN GINGIKDARK VTVGVIGSGD FAKSLTIRLI RCGYHVVIGS    60

RNPKFASEFF PHVVDVTHHE DALTKTNIIF VAIHREHYTS LWDLRHLLVG KILIDVSNNM   120

RINQYPESNA EYLASLFPDS LIVKGFNVVS AWALQLGPKD ASRQVYICSN NIQARQQVIE   180

LARQLNFIPI DLGSLSSARE IENLPLRLFT FWRGPVVVAI SLATFFFLYS FVRDVIHPYA   240

RNQQSDFYKI PIEIVNKTLP IVAITLLSLV YLAGLLAAAY QLYYGTKYRR FPPWLETWLQ   300

CRKQLGLLSF FFAMVHVAYS LCLPMRRSER YLFLNMAYQQ VHANIENSWN EEEVWRIEMY   360

ISFGIMSLGL LSLLAVTSIP SVSNALNWRE FSFIQIFCSF ADTQTELELE FVFLLTLLL    419
```

TABLE LV(d)

Amino acid sequence alignment of 98P4B6 v.1 (SEQ ID NO: 173) and 98P4B6 v.5 (SEQ ID NO: 174)
Score = 788 bits (2036), Expect = 0.0 Identities = 394/395 (99%), Positives = 394/395 (99%)

```
V.1:    1  MESISMMGSPKSLSETCLPNGINGIKDARKVTVGVIGSGDFAKSLTIRLIRCGYHVVIGS     60
           MESISMMGSPKSLSETCLPNGINGIKDARKVTVGVIGSGDFAKSLTIRLIRCGYHVVIGS
V.5:    1  MESISMMGSPKSLSETCLPNGINGIKDARKVTVGVIGSGDFAKSLTIRLIRCGYHVVIGS     60

V.1:   61  RNPKFASEFFPHVVDVTHHEDALTKTNIIFVAIHREHYTSLWDLRHLLVGKILIDVSNNM    120
           RNPKFASEFFPHVVDVTHHEDALTKTNIIFVAIHREHYTSLWDLRHLLVGKILIDVSNNM
V.5:   61  RNPKFASEFFPHVVDVTHHEDALTKTNIIFVAIHREHYTSLWDLRHLLVGKILIDVSNNM    120

V.1:  121  RINQYPESNAEYLASLFPDSLIVKGFNVVSAWALQLGPKDASRQVYICSNNIQARQQVIE    180
           RINQYPESNAEYLASLFPDSLIVKGFNVVSAWALQLGPKDASRQVYICSNNIQARQQVIE
V.5:  121  RINQYPESNAEYLASLFPDSLIVKGFNVVSAWALQLGPKDASRQVYICSNNIQARQQVIE    180

V.1:  181  LARQLNFIPIDLGSLSSAREIENLPLRLFTLWRGPVVVAISLATFFFLYSFVRDVIHPYA    240
           LARQLNFIPIDLGSLSSAREIENLPLRLFT WRGPVVVAISLATFFFLYSFVRDVIHPYA
V.5:  181  LARQLNFIPIDLGSLSSAREIENLPLRLFTFWRGPVVVAISLATFFFLYSFVRDVIHPYA    240

V.1:  241  RNQQSDFYKIPIEIVNKTLPIVAITLLSLVYLAGLLAAAYQLYYGTKYRRFPPWLETWLQ    300
           RNQQSDFYKIPIEIVNKTLPIVAITLLSLVYLAGLLAAAYQLYYGTKYRRFPPWLETWLQ
V.5:  241  RNQQSDFYKIPIEIVNKTLPIVAITLLSLVYLAGLLAAAYQLYYGTKYRRFPPWLETWLQ    300

V.1:  301  CRKQLGLLSFFFAMVHVAYSLCLPMRRSERYLFLNMAYQQVHANIENSWNEEEVWRIEMY    360
           CRKQLGLLSFFFAMVHVAYSLCLPMRRSERYLFLNMAYQQVHANIENSWNEEEVWRIEMY
V.5:  301  CRKQLGLLSFFFAMVHVAYSLCLPMRRSERYLFLNMAYQQVHANIENSWNEEEVWRIEMY    360

V.1:  361  ISFGIMSLGLLSLLAVTSIPSVSNALNWREFSFIQ                            395
           ISFGIMSLGLLSLLAVTSIPSVSNALNWREFSFIQ
V.5:  361  ISFGIMSLGLLSLLAVTSIPSVSNALNWREFSFIQ                            395
```

NOTE:
A SNP CAUSED A SINGLE AMINO ACID DIFFERENCE AT 211.

TABLE LII(e)

Nucleotide sequence of transcript variant 98P4B6 v.6
(SEQ ID NO: 175)

| | | | | | |
|---|---|---|---|---|---|
| cccacgcgtc | cgcggacgcg | tgggcggacg | cgtgggttcc | tcgggccctc | ggcgccacaa | 60 |
| gctgtccggg | cacgcagccc | ctagcggcgc | gtcgctgcca | agccggcctc | cgcgcgcctc | 120 |
| cctccttcct | tctcccctgg | ctgttcgcga | tccagcttgg | gtaggcgggg | aagcagctgg | 180 |
| agtgcgaccg | ccacggcagc | caccctgcaa | ccgccagtcg | gagagctaag | ggcaagtcct | 240 |
| gaggttgggc | ccaggagaaa | gaaggcaagg | agacattgtc | ccaggatatt | cttggtgatc | 300 |
| ttggaagtgt | ccgtatcatg | gaatcaatct | ctatgatggg | aagccctaag | agccttagtg | 360 |
| aaacttgttt | acctaatggc | ataaatggta | tcaaagatgc | aaggaaggtc | actgtaggtg | 420 |
| tgattggaag | tggagatttt | gccaaatcct | tgaccattcg | acttattaga | tgcggctatc | 480 |
| atgtggtcat | aggaagtaga | aatcctaagt | ttgcttctga | attttttcct | catgtggtag | 540 |
| atgtcactca | tcatgaagat | gctctcacaa | aaacaaatat | aatatttgtt | gctatacaca | 600 |
| gagaacatta | tacctccctg | tgggacctga | gacatctgct | tgtgggtaaa | atcctgattg | 660 |
| atgtgagcaa | taacatgagg | ataaaccagt | acccagaatc | caatgctgaa | tatttggctt | 720 |
| cattattccc | agattctttg | attgtcaaag | gatttaatgt | tgtctcagct | tgggcacttc | 780 |
| agttaggacc | taaggatgcc | agccggcagg | tttatatatg | cagcaacaat | attcaagcgc | 840 |
| gacaacaggt | tattgaactt | gcccgccagt | tgaatttcat | tcccattgac | ttgggatcct | 900 |
| tatcatcagc | cagagagatt | gaaaatttac | ccctacgact | ctttactctc | tggagagggc | 960 |
| cagtggtggt | agctataagc | ttggccacat | tttttttcct | ttattcctt | gtcagagatg | 1020 |
| tgattcatcc | atatgctaga | aaccaacaga | gtgacttta | caaaattcct | atagagattg | 1080 |
| tgaataaaac | cttacctata | gttgccatta | ctttgctctc | cctagtatac | cttgcaggtc | 1140 |
| ttctggcagc | tgcttatcaa | ctttattacg | gcaccaagta | taggagattt | ccaccttggt | 1200 |
| tggaaacctg | gttacagtgt | agaaaacagc | ttggattact | aagttttttc | ttcgctatgg | 1260 |
| tccatgttgc | ctacagcctc | tgcttaccga | tgagaaggtc | agagagatat | ttgtttctca | 1320 |
| acatggctta | tcagcaggtt | catgcaaata | ttgaaaactc | ttggaatgag | gaagaagttt | 1380 |
| ggagaattga | aatgtatatc | tcctttggca | taatgagcct | tggcttactt | tccctcctgg | 1440 |
| cagtcacttc | tatcccttca | gtgagcaatg | ctttaaactg | gagagaattc | agttttattc | 1500 |
| agtctacact | tggatatgtc | gctctgctca | taagtacttt | ccatgttta | atttatggat | 1560 |
| ggaaacgagc | ttttgaggaa | gagtactaca | gattttatac | accaccaaac | tttgttcttg | 1620 |
| ctcttgtttt | gccctcaatt | gtaattctgg | gtaagattat | tttattcctt | ccatgtataa | 1680 |
| gccgaaagct | aaaacgaatt | aaaaaaggct | gggaaaagag | ccaatttctg | gaagaaggta | 1740 |
| ttggaggaac | aattcctcat | gtctccccgg | agagggtcac | agtaatgtga | tgataaatgg | 1800 |
| tgttcacagc | tgccatataa | agttctactc | atgccattat | ttttatgact | tctacgttca | 1860 |
| gttacaagta | tgctgtcaaa | ttatcgtggg | ttgaaacttg | ttaaatgaga | tttcaactga | 1920 |
| cttagtgata | gagttttctt | caagttaatt | ttcacaaatg | tcatgtttgc | caatatgaat | 1980 |
| ttttctagtc | aacatattat | tgtaatttag | gtatgtttg | ttttgttttg | cacaactgta | 2040 |
| accctgttgt | tactttatat | ttcataatca | gacaaaaata | cttacagtta | ataatataga | 2100 |
| tataatgtta | aaaacaattt | gcaaaccagc | agaattttaa | gcttttaaaa | taattcaatg | 2160 |
| gatatacatt | tttttctgaa | gattaagatt | ttaattattc | aacttaaaaa | gtagaaatgc | 2220 |
| attattatac | atttttttaa | gaaaggacac | gttatgttag | catctaggta | aggctgcatg | 2280 |

TABLE LII(e)-continued

Nucleotide sequence of transcript variant 98P4B6 v.6
(SEQ ID NO: 175)

```
atagcattcc tatatttctc tcataaaata ggatttgaag gatgaaatta attgtatgaa  2340
gcaatgtgat tatatgaaga gacacaaatt aaaaagacaa attaaacctg aaattatatt  2400
taaaatatat ttgagacatg aaatacatac tgataataca tacctcatga aagattttat  2460
tctttattgt gttacagagc agtttcattt tcatattaat atactgatca ggaagaggat  2520
tcagtaacat ttggcttcca aaactgctat ctctaatacg gtaccaatcc taggaactgt  2580
atactagttc ctacttagaa caaaagtatc aagtttgcac acaagtaatc tgccagctga  2640
cctttgtcgc accttaacca gtcaccactt gctatggtat aggattatac tgatgttctt  2700
tgagggattc tgatgtgcta ggcatggttc taagtacttt acttgtatta tcccatttaa  2760
tacttagaac aaccccgtga gataagtagt tattatcctc attttacaca tgagggaccg  2820
aaggatagaa aagttatttt tcaaaggtct tgcagttaat aaatggcaga gtgagcattc  2880
aagtccaggt agtcatattc cagaggccac ggttttaacc actaggctct agagctcccg  2940
ccgcgcccct atgcattatg ttcacaatgc caatctagat gcttcctctt ttgtataaag  3000
tcactgacat tctttagagt gggttgggtg catccaaaaa tgtataaaaa tattattata  3060
ataaacttat tactgcttgt agggtaattc acagttactt accctattct tgcttggaac  3120
atgagcctgg agacccatgg cagtccatat gcctccctat gcagtgaagg gccctagcag  3180
tgttaacaaa ttgctgagat cccacggagt cttcaaaaa tctctgtaga gttagtcttc  3240
tccttttctc ttcctgagaa gttctcctgc ctgcataacc attcattagg gagtactttta  3300
caagcatgaa ggatattagg gtaagtggct aattataaat ctactctaga gacatataat  3360
catacagatt attcataaaa ttttcagtg ctgtccttcc acatttaatt gcattttgct  3420
caaactgtag aatgccctac attcccccca ccccaatttg ctatttcctt attaaaatag  3480
aaaattatag gcaagataca attatatgcg ttcctcttcc tgaaattata acatttctaa  3540
acttacccac gtagggacta ctgaatccaa ctgccaacaa taaaaagact tttattttagt  3600
agaggctacc tttcccccca gtgactcttt ttctacaact gccttgtcag tttggtaatt  3660
cacttatgat tttctaatgt tctcttggtg aattttatta tcttggaccc tctttttttt  3720
ttttttttaaa gacagagtct tgctctgtca ccca  3754
```

TABLE LIII(e)

Nucleotide sequence alignment of
98P4B6 v.1 (SEQ ID NO: 176) and 98P4B6 v.6 (SEQ ID NO: 177)

Score = 404 bits (210), Expect =
e-109Identities = 210/210 (100%) Strand Plus/Plus

```
v.1:   1  ggacgcgtgggcggacgcgtgggttcctcgggccctcggcgccacaagctgtccgggcac   60
          ||||||||||||||||||||||||||||||||||||||||||||||||||||||||||||
v.6:  14  ggacgcgtgggcggacgcgtgggttcctcgggccctcggcgccacaagctgtccgggcac   73 v.1:  61  gcagcccctagcggcgcgtcgctgccaagccggcctccgcgcgcctccctccttccttct  120
          ||||||||||||||||||||||||||||||||||||||||||||||||||||||||||||
v.6:  74  gcagcccctagcggcgcgtcgctgccaagccggcctccgcgcgcctccctccttccttct  133

V.1: 121  ccctggctgttcgcgatccagcttgggtaggcggggaagcagctggagtgcgaccgcca  180
          ||||||||||||||||||||||||||||||||||||||||||||||||||||||||||||
V.6: 134  ccctggctgttcgcgatccagcttgggtaggcggggaagcagctggagtgcgaccgcca  193

V.1: 181  cggcagccaccctgcaaccgccagtcggag  210
          ||||||||||||||||||||||||||||||
V.6: 194  cggcagccaccctgcaaccgccagtcggag  223
```

TABLE LIII(e)-continued

Nucleotide sequence alignment of
98P4B6 v.1 (SEQ ID NO: 176) and 98P4B6 v.6 (SEQ ID NO: 177)

```
Score = 2630 bits (1368), Expect =
0.0Identities = 1368/1368 (100%) Strand = Plus/Plus V.1:   320 aggatattcttggtgatcttggaagtgtccgtatcatggaatcaatctctatgatgggaa  379
           ||||||||||||||||||||||||||||||||||||||||||||||||||||||||||||
V.6:   283 aggatattcttggtgatcttggaagtgtccgtatcatggaatcaatctctatgatgggaa  342

V.1:   380 gccctaagagccttagtgaaacttgtttacctaatggcataaatggtatcaaagatgcaa  439
           ||||||||||||||||||||||||||||||||||||||||||||||||||||||||||||
V.6:   343 gccctaagagccttagtgaaacttgtttacctaatggcataaatggtatcaaagatgcaa  402

V.1:   440 ggaaggtcactgtaggtgtgattggaagtggagattttgccaaatccttgaccattcgac  499
           ||||||||||||||||||||||||||||||||||||||||||||||||||||||||||||
V.6:   403 ggaaggtcactgtaggtgtgattggaagtggagattttgccaaatccttgaccattcgac  462

V.1:   500 ttattagatgcggctatcatgtggtcataggaagtagaaatcctaagtttgcttctgaat  559
           ||||||||||||||||||||||||||||||||||||||||||||||||||||||||||||
V.6:   463 ttattagatgcggctatcatgtggtcataggaagtagaaatcctaagtttgcttctgaat  522

V.1:   560 tttttcctcatgtggtagatgtcactcatcatgaagatgctctcacaaaaacaaatataa  619
           ||||||||||||||||||||||||||||||||||||||||||||||||||||||||||||
V.6:   523 tttttcctcatgtggtagatgtcactcatcatgaagatgctctcacaaaaacaaatataa  582

V.1:   620 tatttgttgctatacacagagaacattatacctccctgtgggacctgagacatctgcttg  679
           ||||||||||||||||||||||||||||||||||||||||||||||||||||||||||||
V.6:   583 tatttgttgctatacacagagaacattatacctccctgtgggacctgagacatctgcttg  642

V.1:   680 tgggtaaaatcctgattgatgtgagcaataacatgaggataaaccagtacccagaatcca  739
           ||||||||||||||||||||||||||||||||||||||||||||||||||||||||||||
V.6:   643 tgggtaaaatcctgattgatgtgagcaataacatgaggataaaccagtacccagaatcca  702

V.1:   740 atgctgaatatttggcttcattattcccagattctttgattgtcaaaggatttaatgttg  799
           ||||||||||||||||||||||||||||||||||||||||||||||||||||||||||||
V.6:   703 atgctgaatatttggcttcattattcccagattctttgattgtcaaaggatttaatgttg  762

V.1:   800 tctcagcttgggcacttcagttaggacctaaggatgccagccggcaggtttatatatgca  859
           ||||||||||||||||||||||||||||||||||||||||||||||||||||||||||||
V.6:   763 tctcagcttgggcacttcagttaggacctaaggatgccagccggcaggtttatatatgca  822

V.1:   860 gcaacaatattcaagcgcgacaacaggttattgaacttgcccgccagttgaatttcattc  919
           ||||||||||||||||||||||||||||||||||||||||||||||||||||||||||||
V.6:   823 gcaacaatattcaagcgcgacaacaggttattgaacttgcccgccagttgaatttcattc  882

V.1:   920 ccattgacttgggatccttatcatcagccagagagattgaaaatttacccctacgactct  979
           ||||||||||||||||||||||||||||||||||||||||||||||||||||||||||||
V.6:   883 ccattgacttgggatccttatcatcagccagagagattgaaaatttacccctacgactct  942

V.1:   980 ttactctctggagagggccagtggtggtagctataagcttggccacattttttttccttt 1039
           ||||||||||||||||||||||||||||||||||||||||||||||||||||||||||||
V.6:   943 ttactctctggagagggccagtggtggtagctataagcttggccacattttttttccttt 1002

V.1:  1040 attcctttgtcagagatgtgattcatccatatgctagaaaccaacagagtgacttttaca 1099
           ||||||||||||||||||||||||||||||||||||||||||||||||||||||||||||
V.6:  1003 attcctttgtcagagatgtgattcatccatatgctagaaaccaacagagtgacttttaca 1062

V.1:  1100 aaattcctatagagattgtgaataaaaccttacctatagttgccattactttgctctccc 1159
           ||||||||||||||||||||||||||||||||||||||||||||||||||||||||||||
v.6:  1063 aaattcctatagagattgtgaataaaaccttacctatagttgccattactttgctctccc 1122

V.1:  1160 tagtataccttgcaggtcttctggcagctgcttatcaactttattacggcaccaagtata 1219
           ||||||||||||||||||||||||||||||||||||||||||||||||||||||||||||
v.6:  1123 tagtataccttgcaggtcttctggcagctgcttatcaactttattacggcaccaagtata 1182

V.1:  1220 ggagatttccaccttggttggaaacctggttacagtgtagaaaacagcttggattactaa 1279
           ||||||||||||||||||||||||||||||||||||||||||||||||||||||||||||
V.6:  1183 ggagatttccaccttggttggaaacctggttacagtgtagaaaacagcttggattactaa 1242

V.1:  1280 gttttttcttcgctatggtccatgttgcctacagcctctgcttaccgatgagaaggtcag 1339
           ||||||||||||||||||||||||||||||||||||||||||||||||||||||||||||
V.6:  1243 gttttttcttcgctatggtccatgttgcctacagcctctgcttaccgatgagaaggtcag 1302

V.1:  1340 agagatatttgtttctcaacatggcttatcagcaggttcatgcaaatattgaaaactctt 1399
           ||||||||||||||||||||||||||||||||||||||||||||||||||||||||||||
v.6:  1303 agagatatttgtttctcaacatggcttatcagcaggttcatgcaaatattgaaaactctt 1362
```

TABLE LIII(e)-continued

Nucleotide sequence alignment of
98P4B6 v.1 (SEQ ID NO: 176) and 98P4B6 v.6 (SEQ ID NO: 177)

```
v.1:  1400  ggaatgaggaagaagtttggagaattgaaatgtatatctcctttggcataatgagccttg  1459
            ||||||||||||||||||||||||||||||||||||||||||||||||||||||||||||
v.6:  1363  ggaatgaggaagaagtttggagaattgaaatgtatatctcctttggcataatgagccttg  1422

V.1:  1460  gcttactttccctcctggcagtcacttctatcccttcagtgagcaatgctttaaactgga  1519
            ||||||||||||||||||||||||||||||||||||||||||||||||||||||||||||
v.6:  1423  gcttactttccctcctggcagtcacttctatcccttcagtgagcaatgctttaaactgga  1482

V.1:  1520  gagaattcagttttattcagtctacacttggatatgtcgctctgctcataagtactttcc  1579
            ||||||||||||||||||||||||||||||||||||||||||||||||||||||||||||
v.6:  1483  gagaattcagttttattcagtctacacttggatatgtcgctctgctcataagtactttcc  1542

V.1:  1580  atgttttaatttatggatggaaacgagcttttgaggaagagtactacagattttatacac  1639
            ||||||||||||||||||||||||||||||||||||||||||||||||||||||||||||
v.6:  1543  atgttttaatttatggatggaaacgagcttttgaggaagagtactacagattttatacac  1602

V.1:  1640  caccaaactttgttcttgctcttgttttgccctcaattgtaattctgg  1687
            ||||||||||||||||||||||||||||||||||||||||||||||||
v.6:  1603  caccaaactttgttcttgctcttgttttgccctcaattgtaattctgg  1650
```

TABLE LIV(e)

Peptide sequences of protein coded by 98P4B6 v.6
(SEQ ID NO: 178)

```
MESISMMGSP KSLSETCLPN GINGIKDARK VTVGVIGSGD FAKSLTIRLI RCGYHVVIGS   60
RNPKFASEFF PHVVDVTHHE DALTKTNIIF VAIHREHYTS LWDLRHLLVG KILIDVSNNM  120
RINQYPESNA EYLASLFPDS LIVKGFNVVS AWALQLGPKD ASRQVYICSN NIQARQQVIE  180
LARQLNFIPI DLGSLSSARE IENLPLRLFT LWRGPVVVAI SLATFFFLYS FVRDVIHPYA  240
RNQQSDFYKI PIEIVNKTLP IVAITLLSLV YLAGLLAAAY QLYYGTKYRR FPPWLETWLQ  300
CRKQLGLLSF FFAMVHVAYS LCLPMRRSER YLFLNMAYQQ VHANIENSWN EEEVWRIEMY  360
ISFGIMSLGL LSLLAVTSIP SVSNALNWRE FSFIQSTLGY VALLISTFHV LIYGWKRAFE  420
EEYYRFYTPP NFVLALVLPS IVILGKIILF LPCISRKLKR IKKGWEKSQF LEEGIGGTIP  480
HVSPERVTVM                                                         490
```

TABLE LV(e)

Amino acid sequence alignment of 98P4B6 v.1 (SEQ ID NO: 179) and
98P4B6 v.6 (SEQ ID NO: 180)
Score = 888 bits (2294), Expect = 0.0 Identities = 444/444 (100%),
Positives = 444/444 (100%)

```
V.1:    1  MESISMMGSPKSLSETCLPNGINGIKDARKVTVGVIGSGDFAKSLTIRLIRCGYHVVIGS   60
           MESISMMGSPKSLSETCLPNGINGIKDARKVTVGVIGSGDFAKSLTIRLIRCGYHVVIGS
V.6:    1  MESISMMGSPKSLSETCLPNGINGIKDARKVTVGVIGSGDFAKSLTIRLIRCGYHVVIGS   60

V.1:   61  RNPKFASEFFPHVVDVTHHEDALTKTNIIFVAIHREHYTSLWDLRHLLVGKILIDVSNNM  120
           RNPKFASEFFPHVVDVTHHEDALTKTNIIFVAIHREHYTSLWDLRHLLVGKILIDVSNNM
V.6:   61  RNPKFASEFFPHVVDVTHHEDALTKTNIIFVAIHREHYTSLWDLRHLLVGKILIDVSNNM  120

V.1:  121  RINQYPESNAEYLASLFPDSLIVKGFNVVSAWALQLGPKDASRQVYICSNNIQARQQVIE  180
           RINQYPESNAEYLASLFPDSLIVKGFNVVSAWALQLGPKDASRQVYICSNNIQARQQVIE
V.6:  121  RINQYPESNAEYLASLFPDSLIVKGFNVVSAWALQLGPKDASRQVYICSNNIQARQQVIE  180

V.1:  181  LARQLNFIPIDLGSLSSAREIENLPLRLFTLWRGPVVVAISLATFFFLYSFVRDVIHPYA  240
           LARQLNFIPIDLGSLSSAREIENLPLRLFTLWRGPVVVAISLATFFFLYSFVRDVIHPYA
V.6:  181  LARQLNFIPIDLGSLSSAREIENLPLRLFTLWRGPVVVAISLATFFFLYSFVRDVIHPYA  240

V.1:  241  RNQQSDFYKIPIEIVNKTLPIVAITLLSLVYLAGLLAAAYQLYYGTKYRRFPPWLETWLQ  300
           RNQQSDFYKIPIEIVNKTLPIVAITLLSLVYLAGLLAAAYQLYYGTKYRRFPPWLETWLQ
V.6:  241  RNQQSDFYKIPIEIVNKTLPIVAITLLSLVYLAGLLAAAYQLYYGTKYRRFPPWLETWLQ  300
```

TABLE LV(e)-continued

Amino acid sequence alignment of 98P4B6 v.1 (SEQ ID NO: 179) and 98P4B6 v.6 (SEQ ID NO: 180)
Score = 888 bits (2294), Expect = 0.0 Identities = 444/444 (100%), Positives = 444/444 (100%)

```
V.1:  301 CRKQLGLLSFFFAMVHVAYSLCLPMRRSERYLFLNMAYQQVHANIENSWNEEEVWRIEMY 360
          CRKQLGLLSFFFAMVHVAYSLCLPMRRSERYLFLNMAYQQVHANIENSWNEEEVWRIEMY
V.6:  301 CRKQLGLLSFFFAMVHVAYSLCLPMRRSERYLFLNMAYQQVHANIENSWNEEEVWRIEMY 360

V.1:  361 ISFGIMSLGLLSLLAVTSIPSVSNALNWREFSFIQSTLGYVALLISTFHVLIYGWKRAFE 420
          ISFGIMSLGLLSLLAVTSIPSVSNALNWREFSFIQSTLGYVALLISTFHVLIYGWKRAFE
V.6:  361 ISFGIMSLGLLSLLAVTSIPSVSNALNWREFSFIQSTLGYVALLISTFHVLIYGWKRAFE 420

V.1:  421 EEYYRFYTPPNFVLALVLPSIVIL                                    444
          EEYYRFYTPPNFVLALVLPSIVIL
V.6:  421 EEYYRFYTPPNFVLALVLPSIVIL                                    444
```

TABLE LII(f)

Nucleotide sequence of transcript variant 98P4B6 v.7 (SEQ ID NO: 181)

| | |
|---|---|
| ggagaaaatt tacagaaacc cagagccaaa ggtgctctca ggggatcccc tgaaacattc | 60 |
| aaagccattg cggccccaga agcttgggta ggcggggaag cagctggagt gcgaccgccg | 120 |
| cggcagccac cctgcaaccg ccagtcggag gtgcagtccg taggccctgg ccccgggtg | 180 |
| ggcccttggg gagtcggcgc cgctcccggg gagctgcaag gctcgcccct gcccggcgtg | 240 |
| gagggcgcgg ggggcgcgga ggatattctt ggtgatcttg gaagtgtccg tatcatggaa | 300 |
| tcaatctcta tgatgggaag ccctaagagc cttagtgaaa cttttttacc taatggcata | 360 |
| aatggtatca aagatgcaag gaaggtcact gtaggtgtga ttggaagtgg agattttgcc | 420 |
| aaatccttga ccattcgact tattagatgc ggctatcatg tggtcatagg aagtagaaat | 480 |
| cctaagtttg cttctgaatt ttttcctcat gtggtagatg tcactcatca tgaagatgct | 540 |
| ctcacaaaaa caaatataat atttgttgct atacacagag aacattatac ctccctgtgg | 600 |
| gacctgagac atctgcttgt gggtaaaatc ctgattgatg tgagcaataa catgaggata | 660 |
| aaccagtacc cagaatccaa tgctgaatat ttggcttcat tattcccaga ttctttgatt | 720 |
| gtcaaaggat ttaatgttgt ctcagcttgg gcacttcagt taggacctaa ggatgccagc | 780 |
| cggcaggttt atatatgcag caacaatatt caagcgcgac aacaggttat tgaacttgcc | 840 |
| cgccagttga atttcattcc cattgacttg ggatccttat catcagccag agagattgaa | 900 |
| aatttacccc tacgactctt tactctctgg agagggccag tggtggtagc tataagcttg | 960 |
| gccacatttt ttttccttta ttcctttgtc agagatgtga ttcatccata tgctagaaac | 1020 |
| caacagagtg acttttacaa aattcctata gagattgtga ataaaacctt acctatagtt | 1080 |
| gccattactt tgctctccct agtataccte gcaggtcttc tggcagctgc ttatcaactt | 1140 |
| tattacggca ccaagtatag gagatttcca ccttggttgg aaacctggtt acagtgtaga | 1200 |
| aaacagcttg gattactaag ttttttcttc gctatggtcc atgttgccta cagcctctgc | 1260 |
| ttaccgatga aaggtcaga gagatatttg tttctcaaca tggcttatca gcagtctaca | 1320 |
| cttggatatg tcgctctgct cataagtact ttccatgttt taatttatgg atggaaacga | 1380 |
| gcttttgagg aagagtacta cagattttat acaccaccaa actttgttct tgctcttgtt | 1440 |
| ttgccctcaa ttgtaattct ggatctgtct gtggaggttc tggcttcccc agctgctgcc | 1500 |
| tggaaatgct taggtgctaa tatcctgaga ggaggattgt cagagatagt actcccccata | 1560 |
| gagtggcagc aggacaggaa gatcccccca ctctccaccc cgccgccacc ggccatgtgg | 1620 |

TABLE LII(f)-continued

Nucleotide sequence of transcript variant 98P4B6 v.7
(SEQ ID NO: 181)

```
acagaggaag ccggggcgac cgccgaggcc caggaatccg gcatcaggaa caagtctagc  1680
agttccagtc aaatcccggt ggttggggtg gtgacggagg acgatgaggc gcaggattcc  1740
attgatcccc cagagagccc tgatcgtgcc ttaaaagccg cgaattcctg gaggaaccct  1800
gtcctgcctc acactaatgg tgtgggggcca ctgtgggaat tcctgttgag gcttctcaaa  1860
tctcaggctg cgtcaggaac cctgtctctt gcgttcacat cctggagcct tggagagttc  1920
cttgggagtg ggacatggat gaagctggaa accataattc tcagcaaact aacacaggaa  1980
cagaaatcca aacactgcat gttctcactg ataagtggga gttgaacaat gagaacacat  2040
ggacacaggg aggggaacgt cacacaccag ggcctgtcgg gggtgggagg cctagcaatt  2100
cattagaatt acctgtgaag cttttaaaat gtaaggtttg gatggaatgc tcagaccct a  2160 ccttagaccc aattaagccc acagctttga gg                                2192
```

TABLE LIII(f)

Nucleotide sequence alignment of
98P4B6 v.1 (SEQ ID NO: 182) and 98P4B6 v.7 (SEQ ID NO: 183)

Score = 2350 bits (1222), Expect =
0.0Identities = 1230/1234 (99%) Strand = Plus/Plus

```
V.1:  141 agcttgggtaggcggggaagcagctggagtgcgaccgccacggcagccaccctgcaaccg  200
          ||||||||||||||||||||||||||||||||||||| |||||||||||||||||||||
v.7:   81 agcttgggtaggcggggaagcagctggagtgcgaccgccgcggcagccaccctgcaaccg  140

V.1:  201 ccagtcggaggtgcagtccgtaggccctggcccccgggtgggcccttggggagtcggcgc  260
          ||||||||||||||||||||||||||||||||||||||||||||||||||||||||||||
v.7:  141 ccagtcggaggtgcagtccgtaggccctggcccccgggtgggcccttggggagtcggcgc  200

V.1:  261 cgctcccgaggagctgcaaggctcgcccctgcccggcgtggagggcgcgggggcgcgga   320
          |||||||   ||||||||||||||||||||||||||||||||||||||||||||||||
v.7:  201 cgctcccggggagctgcaaggctcgcccctgcccggcgtggagggcgcgggggcgcgga   260

V.1:  321 ggatattcttggtgatcttggaagtgtccgtatcatggaatcaatctctatgatgggaag  380
          ||||||||||||||||||||||||||||||||||||||||||||||||||||||||||||
v.7:  261 ggatattcttggtgatcttggaagtgtccgtatcatggaatcaatctctatgatgggaag  320

V.1:  381 ccctaagagccttagtgaaacttgtttacctaatggcataaatggtatcaaagatgcaag  440
          ||||||||||||||||||||| ||||  |||||||||||||||||||||||||||||||
v.7:  321 ccctaagagccttagtgaaaacttttttacctaatggcataaatggtatcaaagatgcaag  380

V.1:  441 gaaggtcactgtaggtgtgattggaagtggagattttgccaaatccttgaccattcgact  500
          ||||||||||||||||||||||||||||||||||||||||||||||||||||||||||||
v.7:  381 gaaggtcactgtaggtgtgattggaagtggagattttgccaaatccttgaccattcgact  440

V.1:  501 tattagatgcggctatcatgtggtcataggaagtagaaatcctaagtttgcttctgaatt  560
          ||||||||||||||||||||||||||||||||||||||||||||||||||||||||||||
v.7:  441 tattagatgcggctatcatgtggtcataggaagtagaaatcctaagtttgcttctgaatt  500

V.1:  561 ttttcctcatgtggtagatgtcactcatcatgaagatgctctcacaaaaacaaatataat  620
          ||||||||||||||||||||||||||||||||||||||||||||||||||||||||||||
v.7:  501 ttttcctcatgtggtagatgtcactcatcatgaagatgctctcacaaaaacaaatataat  560

V.1:  621 atttgttgctatacacagagaacattatacctccctgtgggacctgagacatctgcttgt  680
          ||||||||||||||||||||||||||||||||||||||||||||||||||||||||||||
v.7:  561 atttgttgctatacacagagaacattatacctccctgtgggacctgagacatctgcttgt  620

V.1:  681 gggtaaaatcctgattgatgtgagcaataacatgaggataaaccagtacccagaatccaa  740
          ||||||||||||||||||||||||||||||||||||||||||||||||||||||||||||
v.7:  621 gggtaaaatcctgattgatgtgagcaataacatgaggataaaccagtacccagaatccaa  680

V.1:  741 tgctgaatatttggcttcattattcccagattctttgattgtcaaaggatttaatgttgt  800
          ||||||||||||||||||||||||||||||||||||||||||||||||||||||||||||
v.7:  681 tgctgaatatttggcttcattattcccagattctttgattgtcaaaggatttaatgttgt  740
```

TABLE LIII(f)-continued

Nucleotide sequence alignment of
98P4B6 v.1 (SEQ ID NO: 182) and 98P4B6 v.7 (SEQ ID NO: 183)

```
V.1:   801  ctcagcttgggcacttcagttaggacctaaggatgccagccggcaggtttatatatgcag  860
            ||||||||||||||||||||||||||||||||||||||||||||||||||||||||||||
V.7:   741  ctcagcttgggcacttcagttaggacctaaggatgccagccggcaggtttatatatgcag  800

V.1:   861  caacaatattcaagcgcgacaacaggttattgaacttgcccgccagttgaatttcattcc  920
            ||||||||||||||||||||||||||||||||||||||||||||||||||||||||||||
V.7:   801  caacaatattcaagcgcgacaacaggttattgaacttgcccgccagttgaatttcattcc  860

V.1:   921  cattgacttgggatccttatcatcagccagagagattgaaaatttaccccctacgactctt  980
            ||||||||||||||||||||||||||||||||||||||||||||||||||||||||||||
V.7:   861  cattgacttgggatccttatcatcagccagagagattgaaaatttaccccctacgactctt  920

V.1:   981  tactctctggagagggccagtggtggtagctataagcttggccacattttttttccttta  1040
            ||||||||||||||||||||||||||||||||||||||||||||||||||||||||||||
V.7:   921  tactctctggagagggccagtggtggtagctataagcttggccacattttttttccttta  980

V.1:  1041  ttcctttgtcagagatgtgattcatccatatgctagaaaccaacagagtgacttttacaa  1100
            ||||||||||||||||||||||||||||||||||||||||||||||||||||||||||||
V.7:   981  ttcctttgtcagagatgtgattcatccatatgctagaaaccaacagagtgacttttacaa  1040

V.1:  1101  aattcctatagagattgtgaataaaaaccttacctatagttgccattactttgctctccct  1160
            ||||||||||||||||||||||||||||||||||||||||||||||||||||||||||||
V.7:  1041  aattcctatagagattgtgaataaaaaccttacctatagttgccattactttgctctccct  1100

V.1:  1161  agtataccttgcaggtcttctggcagctgcttatcaacttttattacggcaccaagtatag  1220
            ||||||||||||||||||||||||||||||||||||||||||||||||||||||||||||
V.7:  1101  agtataccttgcaggtcttctggcagctgcttatcaacttttattacggcaccaagtatag  1160

V.1:  1221  gagatttccaccttggttggaaacctggttacagtgtagaaaacagcttggattactaag  1280
            ||||||||||||||||||||||||||||||||||||||||||||||||||||||||||||
V.7:  1161  gagatttccaccttggttggaaacctggttacagtgtagaaaacagcttggattactaag  1220

V.1:  1281  tttttcttcgctatggtccatgttgcctacagcctctgcttaccgatgagaaggtcaga  1340
            ||||||||||||||||||||||||||||||||||||||||||||||||||||||||||||
V.7:  1221  tttttcttcgctatggtccatgttgcctacagcctctgcttaccgatgagaaggtcaga  1280 v.1:  1341  gagatatttgtttctcaacatggcttatcagcag                           1374
            ||||||||||||||||||||||||||||||||||
v.7:  1281  gagatatttgtttctcaacatggcttatcagcag                           1314
```

Score = 298 bits (155), Expect =
2e-77 Identities = 155/155 (100%) Strand = Plus/Plus

```
v.1:  1537  cagtctacacttggatatgtcgctctgctcataagtactttccatgttttaatttatgga  1596
            ||||||||||||||||||||||||||||||||||||||||||||||||||||||||||||
v.7:  1312  cagtctacacttggatatgtcgctctgctcataagtactttccatgttttaatttatgga  1371 v.1:  1597  tggaaacgagcttttgaggaagagtactacagattttatacaccaccaaactttgttctt  1656
            ||||||||||||||||||||||||||||||||||||||||||||||||||||||||||||
v.7:  1372  tggaaacgagcttttgaggaagagtactacagattttatacaccaccaaactttgttctt  1431 v.1:  1657  gctcttgttttgccctcaattgtaattctggatct                           1691
            |||||||||||||||||||||||||||||||||||
v.7:  1432  gctcttgttttgccctcaattgtaattctggatct                           1466
```

TABLE LIV(f)

Peptide sequences of protein coded by 98P4B6 v.7
(SEQ ID NO: 184)

```
MESISMMGSP KSLSETFLPN GINGIKDARK VTVGVIGSGD FAKSLTIRLI RCGYHVVIGS   60

RNPKFASEFF PHVVDVTHHE DALTKTNIIF VAIHREHYTS LWDLRHLLVG KILIDVSNNM  120

RINQYPESNA EYLASLFPDS LIVKGFNVVS AWALQLGPKD ASRQVYICSN NIQARQQVIE  180

LARQLNFIPI DLGSLSSARE IENLPLRLFT LWRGPVVVAI SLATFFFLYS FVRDVIHPYA  240

RNQQSDFYKI PIEIVNKTLP IVAITLLSLV YLAGLLAAAY QLYYGTKYRR FPPWLETWLQ  300

CRKQLGLLSF FFAMVHVAYS LCLPMRRSER YLFLNMAYQQ STLGYVALLI STFHVLIYGW  360

KRAFEEEYYR FYTPPNFVLA LVLPSIVILD LSVEVLASPA AAWKCLGANI LRGGLSEIVL  420
```

TABLE LIV(f)-continued

Peptide sequences of protein coded by 98P4B6 v.7
(SEQ ID NO: 184)

```
PIEWQQDRKI PPLSTPPPPA MWTEEAGATA EAQESGIRNK SSSSSQIPVV GVVTEDDEAQ   480

DSIDPPESPD RALKAANSWR NPVLPHTNGV GPLWEFLLRL LKSQAASGTL SLAFTSWSLG   540

EFLGSGTWMK LETIILSKLT QEQKSKHCMF SLISGS                             576
```

TABLE LV(f)

Amino acid sequence alignment of 98P4B6 v.1 (SEQ ID NO: 185) and
98P4B6 v.7 (SEQ ID NO: 186)
Score = 753 bits (1944), Expect = 0.0 Identities = 390/446 (87%),
Positives = 390/446 (87%), Gaps = 55/446 (12%)

```
V.1:    1 MESISMMGSPKSLSETCLPNGINGIKDARKVTVGVIGSGDFAKSLTIRLIRCGYHVVIGS   60
          MESISMMGSPKSLSET LPNGINGIKDARKVTVGVIGSGDFAKSLTIRLIRCGYHVVIGS
V.7:    1 MESISMMGSPKSLSETFLPNGINGIKDARKVTVGVIGSGDFAKSLTIRLIRCGYHVVIGS   60

V.1:   61 RNPKFASEFFPHVVDVTHHEDALTKTNIIFVAIHREHYTSLWDLRHLLVGKILIDVSNNM  120
          RNPKFASEFFPHVVDVTHHEDALTKTNIIFVAIHREHYTSLWDLRHLLVGKILIDVSNNM
V.7:   61 RNPKFASEFFPHVVDVTHHEDALTKTNIIFVAIHREHYTSLWDLRHLLVGKILIDVSNNM  120

V.1:  121 RINQYPESNAEYLASLFPDSLIVKGFNVVSAWALQLGPKDASRQVYICSNNIQARQQVIE  180
          RINQYPESNAEYLASLFPDSLIVKGFNVVSAWALQLGPKDASRQVYICSNNIQARQQVIE
V.7:  121 RINQYPESNAEYLASLFPDSLIVKGFNVVSAWALQLGPKDASRQVYICSNNIQARQQVIE  180

V.1:  181 LARQLNFIPIDLGSLSSAREIENLPRLFTLWRGPVVVAISLATFFFLYSFVRDVIHPYA   240
          LARQLNFIPIDLGSLSSAREIENLPRLFTLWRGPVVVAISLATFFFLYSFVRDVIHPYA
V.7:  181 LARQLNFIPIDLGSLSSAREIENLPRLFTLWRGPVVVAISLATFFFLYSFVRDVIHPYA   240

V.1:  241 RNQQSDFYKIPIEIVNKTLPIVAITLLSLVYLAGLLAAAYQLYYGTKYRRFPPWLETWLQ  300
          RNQQSDFYKIPIEIVNKTLPIVAITLLSLVYLAGLLAAAYQLYYGTKYRRFPPWLETWLQ
V.7:  241 RNQQSDFYKIPIEIVNKTLPIVAITLLSLVYLAGLLAAAYQLYYGTKYRRFPPWLETWLQ  300

V.1:  301 CRKQLGLLSFFFAMVHVAYSLCLPMRRSERYLFLNMAYQQVHANIENSWNEEEVWRIEMY  360
          CRKQLGLLSFFFAMVHVAYSLCLPMRRSERYLFLNMAYQQ
V.7:  301 CRKQLGLLSFFFAMVHVAYSLCLPMRRSERYLFLNMAYQQ-------------------  340

V.1:  361 ISFGIMSLGLLSLLAVTSIPSVSNALNWREFSFIQSTLGYVALLISTFHVLIYGWKRAFE  420
                                                  STLGYVALLISTFHVLIYGWKRAFE
V.7:  341 --------------------------------STLGYVALLISTFHVLIYGWKRAFE    365

V.1:  421 EEYYRFYTPPNFVLALVLPSIVILDL                                    446
          EEYYRFYTPPNFVLALVLPSIVILDL
V.7:  366 EEYYRFYTPPNFVLALVLPSIVILDL                                    391
```

TABLE LII(g)

Nucleotide sequence of transcript variant 98P4B6 v.8
(SEQ ID NO: 187)

```
gcccctccg agctccccga ctcctccccg cgctccacgg ctcttcccga ctccagtcag    60
cgttcctcgg gccctcggcg ccacaagctg tccgggcacg cagcccctag cggcgcgtcg   120
ctgccaagcc ggcctccgcg cgcctccctc cttccttctc cctggctgt tcgcgatcca    180 gcttgggtag gcggggaagc agctggagtg cgaccgccac ggcagccacc ctgcaaccgc   240
cagtcggagg tgcagtccgt aggccctggc ccccgggtgg gcccttgggg agtcggcgcc   300
gctcccgagg agctgcaagg ctcgcccctg cccggcgtgg agggcgcggg gggcgcggag   360
gatattcttg gtgatcttgg aagtgtccgt atcatggaat caatctctat gatgggaagc   420
cctaagagcc ttagtgaaac ttgtttacct aatggcataa atggtatcaa agatgcaagg   480
aaggtcactg taggtgtgat tggaagtgga gattttgcca aatccttgac cattcgactt   540
attagatgcg gctatcatgt ggtcatagga agtagaaatc ctaagtttgc ttctgaattt    600
```

TABLE LII(g)-continued

Nucleotide sequence of transcript variant 98P4B6 v.8
(SEQ ID NO: 187)

| | | | | | |
|---|---|---|---|---|---|
| tttcctcatg | tggtagatgt | cactcatcat | gaagatgctc | tcacaaaaac | aaatataata | 660 |
| tttgttgcta | tacacagaga | acattatacc | tccctgtggg | acctgagaca | tctgcttgtg | 720 |
| ggtaaaatcc | tgattgatgt | gagcaataac | atgaggataa | accagtaccc | agaatccaat | 780 |
| gctgaatatt | tggcttcatt | attcccagat | tctttgattg | tcaaaggatt | taatgttgtc | 840 |
| tcagcttggg | cacttcagtt | aggacctaag | gatgccagcc | ggcaggttta | tatatgcagc | 900 |
| aacaatattc | aagcgcgaca | acaggttatt | gaacttgccc | gccagttgaa | tttcattccc | 960 |
| attgacttgg | gatccttatc | atcagccaga | gagattgaaa | atttacccct | acgactcttt | 1020 |
| actctctgga | gagggccagt | ggtggtagct | ataagcttgg | ccacattttt | tttcctttat | 1080 |
| tcctttgtca | gagatgtgat | tcatccatat | gctagaaacc | aacagagtga | cttttacaaa | 1140 |
| attcctatag | agattgtgaa | taaaacctta | cctatagttg | ccattacttt | gctctcccta | 1200 |
| gtataccttg | caggtcttct | ggcagctgct | tatcaacttt | attacggcac | caagtatagg | 1260 |
| agatttccac | cttggttgga | aacctggtta | cagtgtagaa | aacagcttgg | attactaagt | 1320 |
| tttttcttcg | ctatggtcca | tgttgcctac | agcctctgct | taccgatgag | aaggtcagag | 1380 |
| agatatttgt | ttctcaacat | ggcttatcag | caggttcatg | caaatattga | aaactcttgg | 1440 |
| aatgaggaag | aagtttggag | aattgaaatg | tatatctcct | ttggcataat | gagccttggc | 1500 |
| ttactttccc | tcctggcagt | cacttctatc | ccttcagtga | gcaatgcttt | aaactggaga | 1560 |
| gaattcagtt | ttattcagtc | tacacttgga | tatgtcgctc | tgctcataag | tacttttccat | 1620 |
| gttttaattt | atggatggaa | acgagctttt | gaggaagagt | actacagatt | ttatacacca | 1680 |
| ccaaactttg | ttcttgctct | tgttttgccc | tcaattgtaa | ttctgggtaa | gattatttta | 1740 |
| ttccttccat | gtataagccg | aaagctaaaa | cgaattaaaa | aaggctggga | aaagagccaa | 1800 |
| tttctggaag | aaggtatggg | aggaacaatt | cctcatgtct | ccccggagag | ggtcacagta | 1860 |
| atgtgatgac | aaatggtgtt | cacagctgcc | atataaagtt | ctactcatgc | cattattttt | 1920 |
| atgacttcta | cgttcagtta | caagtatgct | gtcaaattat | cgtgggttga | aacttgttaa | 1980 |
| atgagatttc | aactgactta | gtgatagagt | tttcttcaag | ttaattttca | caaatgtcat | 2040 |
| gtttgccaat | atgaatttt | ctagtcaaca | tattattgta | atttaggtat | gttttgtttt | 2100 |
| gttttgcaca | actgtaaccc | tgttgttact | ttatatttca | taatcaggca | aaaatactta | 2160 |
| cagttaataa | tatagatata | atgttaaaaa | caatttgcaa | accagcagaa | ttttaagctt | 2220 |
| ttaaaataat | tcaatggata | tacatttttt | tctgaagatt | aagattttaa | ttattcaact | 2280 |
| taaaaagtag | aaatgcatta | ttatacattt | ttttaagaaa | ggacacgtta | tgttagcatc | 2340 |
| taggtaaggc | tgcatgatag | cattcctata | tttctctcat | aaaataggat | ttgaaggatg | 2400 |
| aaattaattg | tatgaagcaa | tgtgattata | tgaagagaca | caaattaaaa | agacaaatta | 2460 |
| aacctgaaat | tatatttaaa | atatatttga | gacatgaaat | acatactgat | aatacatacc | 2520 |
| tcatgaaaga | ttttattctt | tattgtgtta | cagagcagtt | tcattttcat | attaatatac | 2580 |
| tgatcaggaa | gaggattcag | taacatttgg | cttccaaaac | tgctatctct | aatacggtac | 2640 |
| caatcctagg | aactgtatac | tagttcctac | ttagaacaaa | agtatcaagt | ttgcacacaa | 2700 |
| gtaatctgcc | agctgacctt | tgtcgcacct | taaccagtca | ccacttgcta | tggtatagga | 2760 |
| ttatactgat | gttctttgag | ggattctgat | gtgctaggca | tggttctaag | tactttactt | 2820 |
| gtattatccc | atttaatact | tagaacaacc | ccgtgagata | agtagttatt | atcctcattt | 2880 |

TABLE LII(g)-continued

Nucleotide sequence of transcript variant 98P4B6 v.8
(SEQ ID NO: 187)

| | | | | | |
|---|---|---|---|---|---|
| tacacatgag | ggaccgaagg | atagaaaagt | tattttttcaa | aggtcttgca | gttaataaat | 2940 |
| ggcagagtga | gcattcaagt | ccaggtagtc | atattccaga | ggccacggtt | ttaaccacta | 3000 |
| ggctctagag | ctcccgccgc | gcccctatgc | attatgttca | caatgccaat | ctagatgctt | 3060 |
| cctcttttgt | ataaagtcac | tgacattctt | tagagtgggt | tgggtgcatc | caaaaatgta | 3120 |
| taaaaatatt | attataataa | acttattact | gcttgtaggg | taattcacag | ttacttaccc | 3180 |
| tattcttgct | tggaacatga | gcctggagac | ccatggcagt | ccatatgcct | ccctatgcag | 3240 |
| tgaagggccc | tagcagtgtt | aacaaattgc | tgagatccca | cggagtcttt | caaaaatctc | 3300 |
| tgtagagtta | gtcttctcct | tttctcttcc | tgagaagttc | tcctgcctgc | ataaccattc | 3360 |
| attagggagt | actttacaag | catgaaggat | attagggtaa | gtggctaatt | ataaatctac | 3420 |
| tctagagaca | tataatcata | cagattattc | ataaaatttt | tcagtgctgt | ccttccacat | 3480 |
| ttaattgcat | tttgctcaaa | ctgtagaatg | ccctacattc | cccccacccc | aatttgctat | 3540 |
| ttccttatta | aaatagaaaa | ttataggcaa | gatacaatta | tatgcgttcc | tcttcctgaa | 3600 |
| attataacat | ttctaaactt | acccacgtag | gtactactga | atccaactgc | caacaataaa | 3660 |
| aagacttta | tttagtagag | gctacctttc | ccaccagtga | ctcttttct | acaactgcct | 3720 |
| tgtcagtttg | gtaattcact | tatgattttc | taatgttctc | ttggtgaatt | ttattatctt | 3780 |
| gtaccctctt | tttttttttt | tttttttta | aagacagagt | cttgctctgt | cacccaggct | 3840 |
| ggagtgcagt | ggcacgatct | cggctcactg | caagctctgc | ctcccgggtt | cacgccattc | 3900 |
| tcctgcctca | gcctcccgag | tagctgggac | tacaggtgcc | cgccaccatg | cccggctgat | 3960 |
| ttcttttgt | attttagta | gagacggagt | ttcaccgtgt | tagccaggat | ggtctcgatc | 4020 |
| tcctgacctc | gtgatccgcc | cgccttggcc | tccaaagtgc | tgggattaca | ggtgtgagct | 4080 |
| accgcgcccg | gcctattatc | ttgtactttc | taactgagcc | ctctattttc | tttatttaa | 4140 |
| taatatttct | ccccacttga | gaatcacttg | ttagttcttg | gtaggaattc | agttgggcaa | 4200 |
| tgataacttt | tatgggcaaa | aacattctat | tatagtgaac | taatgaaaat | aacagcgtat | 4260 |
| tttcaatatt | ttcttattcc | ttaaattcca | ctctttaac | actatgctta | accacttaat | 4320 |
| gtgatgaaat | attcctaaaa | gttaaatgac | tattaaagca | tatattgttg | catgtatata | 4380 |
| ttaagtagcc | gatactctaa | ataaaaatac | cactgttaca | gataaatggg | gcctttaaaa | 4440 |
| atatgaaaaa | caaacttgtg | aaaatgtata | aagatgcat | ctgttgtttc | aaatggcact | 4500 |
| atcttctttt | cagtactaca | aaaacagaat | aattttgaag | ttttagaata | aatgtaatat | 4560 |
| atttactata | attctaaatg | tttaaatgct | tttctaaaaa | tgcaaaacta | tgatgtttag | 4620 |
| ttgctttatt | ttacctctat | gtgattattt | ttcttaattg | ttattttta | taatcattat | 4680 |
| ttttctgaac | cattcttctg | gcctcagaag | taggactgaa | ttctactatt | gctaggtgtg | 4740 |
| agaaagtggt | ggtgagaacc | ttagagcagt | ggagatttgc | tacctggtct | gtgttttgag | 4800 |
| aagtgcccct | tagaaagtta | aaagaatgta | gaaaagatac | tcagtcttaa | tcctatgcaa | 4860 |
| aaaaaaaaat | caagtaattg | ttttcctatg | aggaaaataa | ccatgagctg | tatcatgcta | 4920 |
| cttagctttt | atgtaaatat | ttcttatgtc | tcctctatta | agtatttta | aaatcatatt | 4980 |
| taaatatgaa | tctattcatg | ctaacattat | ttttcaaaac | atacatggaa | atttagccca | 5040 |
| gattgtctac | atataaggtt | tttatttgaa | ttgtaaaata | tttaaaagta | tgaataaaat | 5100 |
| atatttatag | gtatttatca | gagatgatta | ttttgtgcta | catacaggtt | ggctaatgag | 5160 |

TABLE LII(g)-continued

Nucleotide sequence of transcript variant 98P4B6 v.8
(SEQ ID NO: 187)

```
ctctagtgtt aaactacctg attaatttct tataaagcag cataaccttg gcttgattaa    5220
ggaattctac tttcaaaaat taatctgata atagtaacaa ggtatattat actttcatta    5280
caatcaaatt atagaaatta cttgtgtaaa agggcttcaa gaatatatcc aattttttaaa   5340
tattttaata tatctcctat ctgataactt aattcttcta aattaccact tgccattaag    5400
ctatttcata ataaattctg tacagtttcc ccccaaaaaa gagatttatt tatgaaatat    5460
ttaaagtttc taatgtggta ttttaaataa agtatcataa atgtaataag taaatattta    5520
tttaggaata ctgtgaacac tgaactaatt attcctgtgt cagtctatga aatccctgtt    5580
ttgaaatacg taaacagcct aaaatgtgtt gaaattattt tgtaaatcca tgacttaaaa    5640
caagatacat acatagtata acacacctca cagtgttaag atttatattg tgaaatgaga    5700
caccctacct tcaattgttc atcagtgggt aaaacaaatt ctgatgtaca ttcaggacaa    5760
atgattagcc ctaaatgaaa ctgtaataat ttcagtggaa actcaatctg ttttttacctt   5820
taaacagtga attttacatg aatgaatggg ttcttcactt ttttttttagt atgagaaaat   5880
tatacagtgc ttaattttca gagattcttt ccatatgtta ctaaaaaatg ttttgttcag    5940
cctaacatac tgagtttttt ttaactttct aaattattga atttccatca tgcattcatc    6000
caaaattaag gcagactgtt tggattcttc cagtggccag atgagctaaa ttaaatcaca    6060
aaagcagatg cttttgtatg atctccaaat tgccaacttt aaggaaatat tctcttgaaa    6120
ttgtctttaa agatctttg cagctttgca gatacccaga ctgagctgga actggaattt    6180
gtcttcctat tgactctact tctttaaaag cggctgccca ttacattcct cagctgtcct    6240
tgcagttagg tgtacatgtg actgagtgtt ggccagtgag atgaagtctc ctcaaaggaa    6300
ggcagcatgt gtccttttc atcccttcat cttgctgctg ggattgtgga taacagga      6360
gccctggcag ctgtctccag aggatcaaag ccacacccaa agagtaaggc agattagaga    6420
ccagaaagac cttgactact tccctacttc cactgctttt tcctgcattt aagccattgt    6480
aaatctgggt gtgttacatg aagtgaaaat taattctttc tgcccttcag ttctttatcc    6540
tgataccatt taacactgtc tgaattaact agactgcaat aattctttct tttgaaagct    6600
tttaaaggat aatgtgcaat tcacattaaa attgattttc cattgtcaat tagttatact    6660
cattttcctg ccttgatctt tcattagata ttttgtatct gcttggaata tattatcttc    6720
tttttaactg tgtaattggt aattactaaa actctgtaat ctccaaaata ttgctatcaa    6780
attacacacc atgttttcta tcattctcat agatctgcct tataaacatt taaataaaaa    6840
gtactattta atgattt                                                  6857
```

TABLE LIII(g)

Nucleotide sequence alignment of
98P4B6 v.1 (SEQ ID NO: 188) and 98P4B6 v.8 (SEQ ID NO: 189)

Score = 3201 bits (1665), Expect =
0.0Identities = 1665/1665 (100%) Strand Plus/Plus

```
v.1:    23  gttcctcgggccctcggcgccacaagctgtccgggcacgcagcccctagcggcgcgtcgc   82
            ||||||||||||||||||||||||||||||||||||||||||||||||||||||||||||
v.8:    62  gttcctcgggccctcggcgccacaagctgtccgggcacgcagcccctagcggcgcgtcgc  121 v.1:    83  tgccaagccggcctccgcgcgcctccctccttccttctcccctggctgttcgcgatccag  142
            ||||||||||||||||||||||||||||||||||||||||||||||||||||||||||||
v.8:   122  tgccaagccggcctccgcgcgcctccctccttccttctcccctggctgttcgcgatccag  181
```

TABLE LIII(g)-continued

Nucleotide sequence alignment of
98P4B6 v.1 (SEQ ID NO: 188) and 98P4B6 v.8 (SEQ ID NO: 189)

```
v.1:  143  cttgggtaggcggggaagcagctggagtgcgaccgccacggcagccaccctgcaaccgcc  202
           ||||||||||||||||||||||||||||||||||||||||||||||||||||||||||||
v.8:  182  cttgggtaggcggggaagcagctggagtgcgaccgccacggcagccaccctgcaaccgcc  241 v.1:  203  agtcggaggtgcagtccgtaggccctggccccgggtgggcccttggggagtcggcgccg   262
           ||||||||||||||||||||||||||||||||||||||||||||||||||||||||||||
v.8:  242  agtcggaggtgcagtccgtaggccctggccccgggtgggcccttggggagtcggcgccg   301 v.1:  263  ctcccgaggagctgcaaggctcgcccctgcccggcgtggagggcgcgggggcgcggagg   322
           ||||||||||||||||||||||||||||||||||||||||||||||||||||||||||||
v.8:  302  ctcccgaggagctgcaaggctcgcccctgcccggcgtggagggcgcgggggcgcggagg   361 v.1:  323  atattcttggtgatcttggaagtgtccgtatcatggaatcaatctctatgatgggaagcc  382
           ||||||||||||||||||||||||||||||||||||||||||||||||||||||||||||
v.8:  362  atattcttggtgatcttggaagtgtccgtatcatggaatcaatctctatgatgggaagcc  421 v.1:  383  ctaagagccttagtgaaacttgtttacctaatggcataaatggtatcaaagatgcaagga  442
           ||||||||||||||||||||||||||||||||||||||||||||||||||||||||||||
v.8:  422  ctaagagccttagtgaaacttgtttacctaatggcataaatggtatcaaagatgcaagga  481 v.1:  443  aggtcactgtaggtgtgattggaagtggagattttgccaaatccttgaccattcgactta  502
           ||||||||||||||||||||||||||||||||||||||||||||||||||||||||||||
v.8:  482  aggtcactgtaggtgtgattggaagtggagattttgccaaatccttgaccattcgactta  541 v.1:  503  ttagatgcggctatcatgtggtcataggaagtagaaatcctaagtttgcttctgaatttt  562
           ||||||||||||||||||||||||||||||||||||||||||||||||||||||||||||
v.8:  542  ttagatgcggctatcatgtggtcataggaagtagaaatcctaagtttgcttctgaatttt  601 v.1:  563  ttcctcatgtggtagatgtcactcatcatgaagatgctctcacaaaaacaaatataatat  622
           ||||||||||||||||||||||||||||||||||||||||||||||||||||||||||||
v.8:  602  ttcctcatgtggtagatgtcactcatcatgaagatgctctcacaaaaacaaatataatat  661 v.1:  623  ttgttgctatacacagagaacattataccccctgtgggacctgagacatctgcttgtgg   682
           ||||||||||||||||||||||||||||||||||||||||||||||||||||||||||||
v.8:  662  ttgttgctatacacagagaacattataccccctgtgggacctgagacatctgcttgtgg   721

V.1:  683  gtaaaatcctgattgatgtgagcaataacatgaggataaaccagtacccagaatccaatg  742
           ||||||||||||||||||||||||||||||||||||||||||||||||||||||||||||
V.8:  722  gtaaaatcctgattgatgtgagcaataacatgaggataaaccagtacccagaatccaatg  781

V.1:  743  ctgaatatttggcttcattattcccagattctttgattgtcaaaggatttaatgttgtct  802
           ||||||||||||||||||||||||||||||||||||||||||||||||||||||||||||
V.8:  782  ctgaatatttggcttcattattcccagattctttgattgtcaaaggatttaatgttgtct  841

V.1:  803  cagcttgggcacttcagttaggacctaaggatgccagccggcaggtttatatatgcagca  862
           ||||||||||||||||||||||||||||||||||||||||||||||||||||||||||||
V.8:  842  cagcttgggcacttcagttaggacctaaggatgccagccggcaggtttatatatgcagca  901

V.1:  863  acaatattcaagcgcgacaacaggttattgaacttgcccgccagttgaatttcattccca  922
           ||||||||||||||||||||||||||||||||||||||||||||||||||||||||||||
V.8:  902  acaatattcaagcgcgacaacaggttattgaacttgcccgccagttgaatttcattccca  961

V.1:  923  ttgacttgggatccttatcatcagccagagagattgaaaatttacccctacgactcttta  982
           ||||||||||||||||||||||||||||||||||||||||||||||||||||||||||||
V.8:  962  ttgacttgggatccttatcatcagccagagagattgaaaatttacccctacgactcttta  1021

V.1:  983  ctctctggagagggccagtggtggtagctataagcttggccacattttttttcctttatt  1042
           ||||||||||||||||||||||||||||||||||||||||||||||||||||||||||||
V.8:  1022 ctctctggagagggccagtggtggtagctataagcttggccacattttttttcctttatt  1081

V.1:  1043 cctttgtcagagatgtgattcatccatatgctagaaaccaacagagtgacttttacaaaa  1102
           ||||||||||||||||||||||||||||||||||||||||||||||||||||||||||||
V.8:  1082 cctttgtcagagatgtgattcatccatatgctagaaaccaacagagtgacttttacaaaa  1141

V.1:  1103 ttcctatagagattgtgaataaaaccttacctatagttgccattactttgctctccctag  1162
           ||||||||||||||||||||||||||||||||||||||||||||||||||||||||||||
V.8:  1142 ttcctatagagattgtgaataaaaccttacctatagttgccattactttgctctccctag  1201

V.1:  1163 tataccttgcaggtcttctggcagctgcttatcaactttattacggcaccaagtatagga  1222
           ||||||||||||||||||||||||||||||||||||||||||||||||||||||||||||
V.8:  1202 tataccttgcaggtcttctggcagctgcttatcaactttattacggcaccaagtatagga  1261
```

TABLE LIII(g)-continued

Nucleotide sequence alignment of
98P4B6 v.1 (SEQ ID NO: 188) and 98P4B6 v.8 (SEQ ID NO: 189)

```
V.1:  1223  gatttccaccttggttggaaacctggttacagtgtagaaaacagcttggattactaagtt  1282
            ||||||||||||||||||||||||||||||||||||||||||||||||||||||||||||
V.8:  1262  gatttccaccttggttggaaacctggttacagtgtagaaaacagcttggattactaagtt  1321

V.1:  1283  ttttcttcgctatggtccatgttgcctacagcctctgcttaccgatgagaaggtcagaga  1342
            ||||||||||||||||||||||||||||||||||||||||||||||||||||||||||||
V.8:  1322  ttttcttcgctatggtccatgttgcctacagcctctgcttaccgatgagaaggtcagaga  1381

V.1:  1343  gatatttgtttctcaacatggcttatcagcaggttcatgcaaatattgaaaactcttgga  1402
            ||||||||||||||||||||||||||||||||||||||||||||||||||||||||||||
V.8:  1382  gatatttgtttctcaacatggcttatcagcaggttcatgcaaatattgaaaactcttgga  1441

V.1:  1403  atgaggaagaagtttggagaattgaaatgtatatctcctttggcataatgagccttggct  1462
            ||||||||||||||||||||||||||||||||||||||||||||||||||||||||||||
V.8:  1422  atgaggaagaagtttggagaattgaaatgtatatctcctttggcataatgagccttggct  1501

V.1:  1463  tactttccctcctggcagtcacttctatcccttcagtgagcaatgctttaaactggagag  1522
            ||||||||||||||||||||||||||||||||||||||||||||||||||||||||||||
V.8:  1502  tactttccctcctggcagtcacttctatcccttcagtgagcaatgctttaaactggagag  1561

V.1:  1523  aattcagttttattcagtctacacttggatatgtcgctctgctcataagtactttccatg  1582
            ||||||||||||||||||||||||||||||||||||||||||||||||||||||||||||
V.8:  1562  aattcagttttattcagtctacacttggatatgtcgctctgctcataagtactttccatg  1621

V.1:  1583  ttttaatttatggatggaaacgagcttttgaggaagagtactacagatttatacaccac  1642
            ||||||||||||||||||||||||||||||||||||||||||||||||||||||||||||
v.8:  1622  ttttaatttatggatggaaacgagcttttgaggaagagtactacagatttatacaccac  1681

V.1:  1643  caaactttgttcttgctcttgttttgccctcaattgtaattctgg                1687
            |||||||||||||||||||||||||||||||||||||||||||||
v.8:  1682  caaactttgttcttgctcttgttttgccctcaattgtaattctgg                1726

Score = 1381 bits (718), Expect =
0.0Identities = 725/726 (99%), Gaps = 1/726 (0%) Strand = Plus/Plus V.1:  1687  gatcttttgcagctttgcagatacccagactgagctggaactggaatttgtcttcctatt  1746
            ||||||||||||||||||||||||||||||||||||||||||||||||||||||||||||
v.8:  6132  gatcttttgcagctttgcagatacccagactgagctggaactggaatttgtcttcctatt  6191

V.1:  1747  gactctacttctttaaaagcggctgcccattacattcctcagctgtccttgcagttaggt  1806
            ||||||||||||||||||||||||||||||||||||||||||||||||||||||||||||
v.8:  6192  gactctacttctttaaaagcggctgcccattacattcctcagctgtccttgcagttaggt  6251

V.1:  1807  gtacatgtgactgagtgttggccagtgagatgaagtctcctcaaaggaaggcagcatgtg  1866
            ||||||||||||||||||||||||||||||||||||||||||||||||||||||||||||
v.8:  6252  gtacatgtgactgagtgttggccagtgagatgaagtctcctcaaaggaaggcagcatgtg  6311

V.1:  1867  tccttttcatcccttcatcttgctgctgggattgtggatataacaggagccctggcagc  1926
            ||||||||||||||||||||||||||||||||||||||||||||||||||||||||||||
v.8:  6312  tccttttcatcccttcatcttgctgctgggattgtggatataacaggagccctggcagc  6371

V.1:  1927  tgtctccagaggatcaaagccacacccaaagagtaaggcagattagagaccagaaagacc  1986
            ||||||||||||||||||||||||||||||||||||||||||||||||||||||||||||
v.8:  6372  tgtctccagaggatcaaagccacacccaaagagtaaggcagattagagaccagaaagacc  6431

V.1:  1987  ttgactacttccctacttccactgctttt-cctgcatttaagccattgtaaatctgggtg  2045
            ||||||||||||||||||||||||||||| ||||||||||||||||||||||||||||||
v.8:  6432  ttgactacttccctacttccactgcttttcctgcatttaagccattgtaaatctgggtg   6491

V.1:  2046  tgttacatgaagtgaaaattaattctttctgcccttcagttctttatcctgataccattt  2105
            ||||||||||||||||||||||||||||||||||||||||||||||||||||||||||||
v.8:  6492  tgttacatgaagtgaaaattaattctttctgcccttcagttctttatcctgataccattt  6551

V.1:  2106  aacactgtctgaattaactagactgcaataattctttcttttgaaagcttttaaaggata  2165
            ||||||||||||||||||||||||||||||||||||||||||||||||||||||||||||
v.8:  6552  aacactgtctgaattaactagactgcaataattctttcttttgaaagcttttaaaggata  6611

V.1:  2166  atgtgcaattcacattaaaattgattttccattgtcaattagttatactcattttcctgc  2225
            ||||||||||||||||||||||||||||||||||||||||||||||||||||||||||||
v.8:  6612  atgtgcaattcacattaaaattgattttccattgtcaattagttatactcattttcctgc  6671

V.1:  2226  cttgatctttcattagatattttgtatctgcttggaatatattatcttctttttaactgt  2285
            ||||||||||||||||||||||||||||||||||||||||||||||||||||||||||||
v.8:  6672  cttgatctttcattagatattttgtatctgcttggaatatattatcttctttttaactgt  6731
```

TABLE LIII(g)-continued

Nucleotide sequence alignment of
98P4B6 v.1 (SEQ ID NO: 188) and 98P4B6 v.8 (SEQ ID NO: 189)

```
V.1:  2286  gtaattggtaattactaaaactctgtaatctccaaaatattgctatcaaattacacacca  2345
            ||||||||||||||||||||||||||||||||||||||||||||||||||||||||||||
v.8:  6732  gtaattggtaattactaaaactctgtaatctccaaaatattgctatcaaattacacacca  6791

V.1:  2346  tgttttctatcattctcatagatctgccttataaacatttaaataaaaagtactatttaa  2405
            ||||||||||||||||||||||||||||||||||||||||||||||  ||||||||||||
v.8:  6792  tgttttctatcattctcatagatctgccttataaacatttaaatccccgtactatttaa  6851

V.1:  2406  tgattt                                                         2411
            ||||||
v.8:  6852  tgattt                                                         6857
```

TABLE LIV(g)

Peptide sequences of protein coded by 98P4B6 v.8
(SEQ ID NO: 190)

| | | | | | |
|---|---|---|---|---|---|
| MESISMMGSP | KSLSETCLPN | GINGIKDARK | VTVGVIGSGD | FAKSLTIRLI | RCGYHVVIGS | 60 |
| RNPKFASEFF | PHVVDVTHHE | DALTKTNIIF | VAIHREHYTS | LWDLRHLLVG | KILIDVSNNM | 120 |
| RINQYPESNA | EYLASLFPDS | LIVKGFNVVS | AWALQLGPKD | ASRQVYICSN | NIQARQQVIE | 180 |
| LARQLNFIPI | DLGSLSSARE | IENLPLRLFT | LWRGPVVVAI | SLATFFFLYS | FVRDVIHPYA | 240 |
| RNQQSDFYKI | PIEIVNKTLP | IVAITLLSLV | YLAGLLAAAY | QLYYGTKYRR | FPPWLETWLQ | 300 |
| CRKQLGLLSF | FFAMVHVAYS | LCLPMRRSER | YLFLNMAYQQ | VHANIENSWN | EEEVWRIEMY | 360 |
| ISFGIMSLGL | LSLLAVTSIP | SVSNALNWRE | FSFIQSTLGY | VALLISTFHV | LIYGWKRAFE | 420 |
| EEYYRFYTPP | NFVLALVLPS | IVILGKIILF | LPCISRKLKR | IKKGWEKSQF | LEEGMGGTIP | 480 |
| HVSPERVTVM | | | | | | 490 |

TABLE LV(g)

Amino acid sequence alignment of 98P4B6 v.1 (SEQ ID NO: 191) and
98P4B6 v.8 (SEQ ID NO: 192)
Score = 888 bits (2294), Expect = 0.0 Identities = 444/444 (100%),
Positives = 444/444 (100%)

```
V.1:    1  MESISMMGSPKSLSETCLPNGINGIKDARKVTVGVIGSGDFAKSLTIRLIRCGYHVVIGS   60
           MESISMMGSPKSLSETCLPNGINGIKDARKVTVGVIGSGDFAKSLTIRLIRCGYHVVIGS
V.8:    1  MESISMMGSPKSLSETCLPNGINGIKDARKVTVGVIGSGDFAKSLTIRLIRCGYHVVIGS   60

V.1:   61  RNPKFASEFFPHVVDVTHHEDALTKTNIIFVAIHREHYTSLWDLRHLLVGKILIDVSNNM  120
           RNPKFASEFFPHVVDVTHHEDALTKTNIIFVAIHREHYTSLWDLRHLLVGKILIDVSNNM
V.8:   61  RNPKFASEFFPHVVDVTHHEDALTKTNIIFVAIHREHYTSLWDLRHLLVGKILIDVSNNM  120

V.1:  121  RINQYPESNAEYLASLFPDSLIVKGFNVVSAWALQLGPKDASRQVYICSNNIQARQQVIE  180
           RINQYPESNAEYLASLFPDSLIVKGFNVVSAWALQLGPKDASRQVYICSNNIQARQQVIE
V.8:  121  RINQYPESNAEYLASLFPDSLIVKGFNVVSAWALQLGPKDASRQVYICSNNIQARQQVIE  180

V.1:  181  LARQLNFIPIDLGSLSSAREIENLPLRLFTLWRGPVVVAISLATFFFLYSFVRDVIHPYA  240
           LARQLNFIPIDLGSLSSAREIENLPLRLFTLWRGPVVVAISLATFFFLYSFVRDVIHPYA
V.8:  181  LARQLNFIPIDLGSLSSAREIENLPLRLFTLWRGPVVVAISLATFFFLYSFVRDVIHPYA  240

V.1:  241  RNQQSDFYKIPIEIVNKTLPIVAITLLSLVYLAGLLAAAYQLYYGTKYRRFPPWLETWLQ  300
           RNQQSDFYKIPIEIVNKTLPIVAITLLSLVYLAGLLAAAYQLYYGTKYRRFPPWLETWLQ
V.8:  241  RNQQSDFYKIPIEIVNKTLPIVAITLLSLVYLAGLLAAAYQLYYGTKYRRFPPWLETWLQ  300

V.1:  301  CRKQLGLLSFFFAMVHVAYSLCLPMRRSERYLFLNMAYQQVHANIENSWNEEEVWRIEMY  360
           CRKQLGLLSFFFAMVHVAYSLCLPMRRSERYLFLNMAYQQVHANIENSWNEEEVWRIEMY
V.8:  301  CRKQLGLLSFFFAMVHVAYSLCLPMRRSERYLFLNMAYQQVHANIENSWNEEEVWRIEMY  360

V.1:  361  ISFGIMSLGLLSLLAVTSIPSVSNALNWREFSFIQSTLGYVALLISTFHVLIYGWKRAFE  420
           ISFGIMSLGLLSLLAVTSIPSVSNALNWREFSFIQSTLGYVALLISTFHVLIYGWKRAFE
```

TABLE LV(g)-continued

Amino acid sequence alignment of 98P4B6 v.1 (SEQ ID NO: 191) and
98P4B6 v.8 (SEQ ID NO: 192)
Score = 888 bits (2294), Expect = 0.0Identities = 444/444 (100%),
Positives = 444/444 (100%)

```
V.8:  361 ISFGIMSLGLLSLLAVTSIPSVSNALNWREFSFIQSTLGYVALLISTFHVLIYGWKRAFE 420

V.1:  421 EEYYRFYTPPNFVLALVLPSIVIL                                     444
          EEYYRFYTPPNFVLALVLPSIVIL
V.8:  421 EEYYRFYTPPNFVLALVLPSIVIL                                     444
```

SEQUENCE LISTING (197 sequences)

SEQ ID NO: 1 - DNA, 183 bp, Homo sapian
tttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtccttttt

SEQ ID NO: 2 - DNA, 2453 bp, Homo sapian
  CDS (355)...(1719)
ggacgcgtgggcggacgcgtgggttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgcttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaaaaaaaaaaaaaaaaaaaaaaaaaaaaaaaaaaaaaaaaaa

SEQ ID NO: 3 - protein, 454 aa, Homo sapian
MESISMMGSPKSLSETCLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILDLLQLCRYPD

SEQ ID NO: 4 - DNA, 3041 bp, Homo sapian
  CDS (4)...(138)
agtggatcccccgggctgcaggctctctctctctctctctcttccgggttcacgccattctcctgcctcagcctcccgagtagctgggactacaggtgcccgccaccatgcccggctgatttctttttgtatttttagtacagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaacaaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttcccccaaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaataagtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaaaaaaaaaaaaaaaaaaaaaaaaa

SEQ ID NO: 5 - protein, 44 aa, Homo sapian
GSPGLQALSLSLSSGFTPFSCLSLPSSWDYRCPPPCPADFFLYF

SEQ ID NO: 6 - DNA, 2280 bp, Homo sapian
  CDS (188)...(1552)
ttctgctatagagatggaacagtatatggaaagctcccaagaaagtgaagagaggaaattggaaaattgtgagtggaccttctgatactgctcctccttgcgtggaaaaggggaaagaactgcatgcatattattcagcgtcctatattcaaaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaaaaaaaaaaaaaaaaaaaaa

SEQ ID NO: 7 - protein, 454 aa, Homo sapian; identical to SEQ ID NO: 3

SEQ ID NO: 8 - DNA, 2374 bp, Homo sapian
  CDS (318)...(1682)
cccacgcgtccgcggacgcgtgggcggacgcgtgggttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggagagctaagggcaagtcctgaggttgggcccaggagaaagaaggcaaggagacattgtcccaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgcttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 9 - protein, 454 aa, Homo sapian; identical to SEQ ID NO: 3

SEQ ID NO: 10 - DNA, 2249 bp, Homo sapian
  CDS (318)...(1577)
cccacgcgtccgcggacgcgtgggcggacgcgtgggttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgctacggcagccaccctgcaaccgccagtcggagagctaagggcaagtcctgaggttgggcccaggagaaagaaggcaaggagacattgtcccaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactttctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcggtgagcaatgctttaaactggagagaattcagttttattcagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaccaaaaaaaaaaaaaaaaaaaaaaaaaaaa

SEQ ID NO: 11 - protein, 419 aa, Homo sapian [sequence omitted]

SEQ ID NO: 12 - DNA, 3754 bp, Homo sapian
  CDS (318)...(1790)
cccacgcgtccgcggacgcgtgggcggacgcgtgggttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggagagctaagggcaagtcctgaggttgggcccaggagaaagaaggcaaggagacattgtcccaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtattggaggaacaattcctcatgtctccccggagagggtcacagtaatgtgatgataaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcagacaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtagggactactgaatccaactgccaacaataaaaagacttttatttagtagaggctacctttccccccagtgactctttttctacaactgccttgtcagtttggtaattcacttatgattttctaatgttctcttggtgaattttattatcttggaccctctttttttttttttttaaagacagagtcttgctctgtcaccca

SEQ ID NO: 13 - protein, 490 aa, Homo sapian
MESISMMGSPKSLSETCLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILGKIILFLPCISRKLKRIKKGWEKSQFLEEGIGGTIPHVSPERVTVM

SEQ ID NO: 14 - DNA, 2192 bp, Homo sapian
  CDS (295)...(2025)
ggagaaaatttacagaaacccagagccaaaggtgctctcaggggatcccctgaaacattcaaagccattgcggccccagaagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatctgtctgtggaggttctggcttccccagctgctgcctggaaatgcttaggtgctaatatcctgagaggaggattgtcagagatagtactccccatagagtggcagcaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggattccattgatcccccagagagccctgatcgtgccttaaaagccgcgaattcctggaggaaccctgtcctgcctcacactaatggtgtggggccactgtgggaattcctgttgaggcttctcaaatctcaggctgcgtcaggaaccctgtctcttgcgttcacatcctggagccttggagagttccttgggagtgggacatggatgaagctggaaaccataattctcagcaaactaacacaggaacagaaatccaaacactgcatgttctcactgataagtgggagttgaacaatgagaacacatggacacagggaggggaacgtcacacaccagggcctgtcgggggtgggaggcctagcaattcattagaattacctgtgaagcttttaaaatgtaaggtttggatggaatgctcagaccctaccttagacccaattaagcccacagctttgagg

SEQ ID NO: 15 - protein, 576 aa, Homo sapian
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQSTLGYVALLISTFHVLIYGWKRAFEEEYYRFYTPPNFVLALVLPSIVILDLSVEVLASPAAAWKCLGANILRGGLSEIVLPIEWQQDRKIPPLSTPPPPAMWTEEAGATAEAQESGIRNKSSSSSQIPVVGVVTEDDEAQDSIDPPESPDRALKAANSWRNPVLPHTNGVGPLWEFLLRLLKSQAASGTLSLAFTSWSLGEFLGSGTWMKLETIILSKLTQEQKSKHCMFSLISGS

SEQ ID NO: 16 - DNA, 6857 bp, Homo sapian
  CDS (394)...(1866)
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 17 - protein, 490 aa, Homo sapian
MESISMMGSPKSLSETCLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILGKIILFLPCISRKLKRIKKGWEKSQFLEEGMGGTIPHVSPERVTVM

SEQ ID NO: 18 - DNA, 2453 bp, Homo sapian
  CDS (355)...(1719)
ggacgcgtgggcggacgcgtgggttcctcgggccctcggcgccacgagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgcttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaaaaaaaaaaaaaaaaaaaaaaaaaaaaaaaaaaaaaaaaaa

SEQ ID NO: 19 - protein, 454 aa, Homo sapian; identical to SEQ ID NO: 3

SEQ ID NO: 20 - DNA, 2453 bp, Homo sapian
  CDS (355)...(1719)
ggacgcgtgggcggacgcgtgggttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgctacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgcttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaaaaaaaaaaaaaaaaaaaaaaaaaaaaaaaaaaaaaaaaaa

SEQ ID NO: 21 - protein, 454 aa, Homo sapian; identical to SEQ ID NO: 3

SEQ ID NO: 22 - DNA, 2453 bp, Homo sapian
  CDS (355)...(1719)
ggacgcgtgggcggacgcgtgggttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccgcggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgcttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaaaaaaaaaaaaaaaaaaaaaaaaaaaaaaaaaaaaaaaaaa

SEQ ID NO: 23 - protein, 454 aa, Homo sapian; identical to SEQ ID NO: 3

SEQ ID NO: 24 - DNA, 2453 bp, Homo sapian
  CDS (355)...(1719)
ggacgcgtgggcggacgcgtgggttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgcttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaaaaaaaaaaaaaaaaaaaaaaaaaaaaaaaaaaaaaaaaaa

SEQ ID NO: 25 - protein, 454 aa, Homo sapian; identical to SEQ ID NO: 3

SEQ ID NO: 26 - DNA, 2453 bp, Homo sapian
  CDS (355)...(1719)
ggacgcgtgggcggacgcgtgggttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgcttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaaaaaaaaaaaaaaaaaaaaaaaaaaaaaaaaaaaaaaaaaa

SEQ ID NO: 27 - protein, 454 aa, Homo sapian
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILDLLQLCRYPD

SEQ ID NO: 28 - DNA, 2453 bp, Homo sapian
  CDS (355)...(1719)
ggacgcgtgggcggacgcgtgggttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactttctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgcttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaaaaaaaaaaaaaaaaaaaaaaaaaaaaaaaaaaaaaaaaaa

SEQ ID NO: 29 - protein, 454 aa, Homo sapian
MESISMMGSPKSLSETCLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTFWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILDLLQLCRYPD

SEQ ID NO: 30 - DNA, 2453 bp, Homo sapian
  CDS (355)...(1719)
ggacgcgtgggcggacgcgtgggttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgcttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaaaaaaaaaaaaaaaaaaaaaaaaaaaaaaaaaaaaaaaaaa

SEQ ID NO: 31 - protein, 454 aa, Homo sapian; identical to SEQ ID NO: 3

SEQ ID NO: 32 - DNA, 2453 bp, Homo sapian
  CDS (355)...(1719)
ggacgcgtgggcggacgcgtgggttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcggtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgcttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaaaaaaaaaaaaaaaaaaaaaaaaaaaaaaaaaaaaaaaaaa

SEQ ID NO: 33 - protein, 454 aa, Homo sapian; identical to SEQ ID NO: 3

SEQ ID NO: 34 - DNA, 2453 bp, Homo sapian
  CDS (355)...(1719)
ggacgcgtgggcggacgcgtgggttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctatggactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgcttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaaaaaaaaaaaaaaaaaaaaaaaaaaaaaaaaaaaaaaaaaa

SEQ ID NO: 35 - protein, 454 aa, Homo sapian; identical to SEQ ID NO: 3

SEQ ID NO: 36 - DNA, 2453 bp, Homo sapian
  CDS (355)...(1719)
ggacgcgtgggcggacgcgtgggttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgcttttcctgcatttaagccattgtaaatctgggtgggttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaaaaaaaaaaaaaaaaaaaaaaaaaaaaaaaaaaaaaaaaaa

SEQ ID NO: 37 - protein, 454 aa, Homo sapian; identical to SEQ ID NO: 3

SEQ ID NO: 38 - DNA, 2453 bp, Homo sapian
  CDS (355)...(1719)
ggacgcgtgggcggacgcgtgggttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgcttttcctgcatttaagccattgtaaatctgggtgtgttacatgaagtgaaaattaattctttctgcccttcagttctttatcctgataccacttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaaaaaaaaaaaaaaaaaaaaaaaaaaaaaaaaaaaaaaaaaa

SEQ ID NO: 39 - protein, 454 aa, Homo sapian; identical to SEQ ID NO: 3

SEQ ID NO: 40 - DNA, 2192 bp, Homo sapian
  CDS (295)...(2025)
ggagaaaatttacagaaacccagagccaaaggtgctctcaggggatcccctgaaacattcaaagccattgcggccccagaagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatctgtctgtggaggttctggcttccccagctgctgcctggaaatgcttaggtgctaatatcctgagaggaggattgtcagagatagtactccccatagagtggcagcaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggattccattgatcccccagagagccctgatcgtgccttaaaagccgcgaattcctggaggaaccctgtcctgcctcacactaatggtgtggggccactgtgggaattcctgttgaggcttctcaaatctcaggctgcgtcaggaaccctgtctcttgcgttcacatcctggagccttggagagttccttgggagtgggacatggatgaagctggaaaccatcattctcagcaaactaacacaggaacagaaatccaaacactgcatgttctcactgataagtgggagttgaacaatgagaacacatggacacagggaggggaacgtcacacaccagggcctgtcgggggtgggaggcctagcaattcattagaattacctgtgaagcttttaaaatgtaaggtttggatggaatgctcagaccctaccttagacccaattaagcccacagctttgagg

SEQ ID NO: 41 - protein, 576 aa, Homo sapian; identical to SEQ ID NO: 15

SEQ ID NO: 42 - DNA, 2192 bp, Homo sapian
  CDS (295)...(2025)
ggagaaaatttacagaaacccagagccaaaggtgctctcaggggatcccctgaaacattcaaagccattgcggccccagaagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatctgtctgtggaggttctggcttccccagctgctgcctggaaatgcttaggtgctaatatcctgagaggaggattgtcagagatagtactccccatagagtggcagcaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggattccattgatcccccagagagccctgatcgtgccttaaaagccgcgaattcctggaggaaccctgtcctgcctcacactaatggtgtggggccactgtgggaattcctgttgaggcttctcaaatctcaggctgcgtcaggaaccctgtctcttgcgttcacatcctggagccttggagagttccttgggagtgggacatggatgaagctggaaaccataattctcagcaaactaacacaggaacagaaaaccaaacactgcatgttctcactgataagtgggagttgaacaatgagaacacatggacacagggaggggaacgtcacacaccagggcctgtcgggggtgggaggcctagcaattcattagaattacctgtgaagcttttaaaatgtaaggtttggatggaatgctcagaccctaccttagacccaattaagcccacagctttgagg

SEQ ID NO: 43 - protein, 576 aa, Homo sapian
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQSTLGYVALLISTFHVLIYGWKRAFEEEYYRFYTPPNFVLALVLPSIVILDLSVEVLASPAAAWKCLGANILRGGLSEIVLPIEWQQDRKIPPLSTPPPPAMWTEEAGATAEAQESGIRNKSSSSSQIPVVGVVTEDDEAQDSIDPPESPDRALKAANSWRNPVLPHTNGVGPLWEFLLRLLKSQAASGTLSLAFTSWSLGEFLGSGTWMKLETIILSKLTQEQKTKHCMFSLISGS

SEQ ID NO: 44 - DNA, 2192 bp, Homo sapian
  CDS (295)...(2025)
ggagaaaatttacagaaacccagagccaaaggtgctctcaggggatcccctgaaacattcaaagccattgcggccccagaagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatctgtctgtggaggttctggcttccccagctgctgcctggaaatgcttaggtgctaatatcctgagaggaggattgtcagagatagtactccccatagagtggcagcaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggattccattgatcccccagagagccctgatcgtgccttaaaagccgcgaattcctggaggaaccctgtcctgcctcacactaatggtgtggggccactgtgggaattcctgttgaggcttctcaaatctcaggctgcgtcaggaaccctgtctcttgcgttcacatcctggagccttggagagttccttgggagtgggacatggatgaagctggaaaccataattctcagcaaactaacacaggaacagaaatccaaacactgcatgttctcactcataagtgggagttgaacaatgagaacacatggacacagggaggggaacgtcacacaccagggcctgtcgggggtgggaggcctagcaattcattagaattacctgtgaagcttttaaaatgtaaggtttggatggaatgctcagaccctaccttagacccaattaagcccacagctttgagg

SEQ ID NO: 45 - protein, 576 aa, Homo sapian; identical to SEQ ID NO: 15

SEQ ID NO: 46 - DNA, 2192 bp, Homo sapian
  CDS (295)...(2025)
ggagaaaatttacagaaacccagagccaaaggtgctctcaggggatcccctgaaacattcaaagccattgcggccccagaagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatctgtctgtggaggttctggcttccccagctgctgcctggaaatgcttaggtgctaatatcctgagaggaggattgtcagagatagtactccccatagagtggcagcaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggattccattgatcccccagagagccctgatcgtgccttaaaagccgcgaattcctggaggaaccctgtcctgcctcacactaatggtgtggggccactgtgggaattcctgttgaggcttctcaaatctcaggctgcgtcaggaaccctgtctcttgcgttcacatcctggagccttggagagttccttgggagtgggacatggatgaagctggaaaccataattctcagcaaactaacacaggaacagaaatccaaacactgcatgttctcacttataagtgggagttgaacaatgagaacacatggacacagggaggggaacgtcacacaccagggcctgtcgggggtgggaggcctagcaattcattagaattacctgtgaagcttttaaaatgtaaggtttggatggaatgctcagaccctaccttagacccaattaagcccacagctttgagg

SEQ ID NO: 47 - protein, 576 aa, Homo sapian; identical to SEQ ID NO: 15

SEQ ID NO: 48 - DNA, 2192 bp, Homo sapian
  CDS (295)...(2025)
ggagaaaatttacagaaacccagagccaaaggtgctctcaggggatcccctgaaacattcaaagccattgcggccccagaagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatctgtctgtggaggttctggcttccccagctgctgcctggaaatgcttaggtgctaatatcctgagaggaggattgtcagagatagtactccccatagagtggcagcaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggattccattgatcccccagagagccctgatcgtgccttaaaagccgcgaattcctggaggaaccctgtcctgcctcacactaatggtgtggggccactgtgggaattcctgttgaggcttctcaaatctcaggctgcgtcaggaaccctgtctcttgcgttcacatcctggagccttggagagttccttgggagtgggacatggatgaagctggaaaccataattctcagcaaactaacacaggaacagaaatccaaacactgcatgttctcactgataagtgggagttgaacaatgagaacacatggacacagggaggggaacatcacacaccagggcctgtcgggggtgggaggcctagcaattcattagaattacctgtgaagcttttaaaatgtaaggtttggatggaatgctcagaccctaccttagacccaattaagcccacagctttgagg

SEQ ID NO: 49 - protein, 576 aa, Homo sapian; identical to SEQ ID NO: 15

SEQ ID NO: 50 - DNA, 6857 bp, Homo sapian
  CDS (394)...(1866)
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccaaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 51 - protein, 490 aa, Homo sapian
MESISMMGSPKSLSETCLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILGKIILFLPCISQKLKRIKKGWEKSQFLEEGMGGTIPHVSPERVTVM

SEQ ID NO: 52 - DNA, 6857 bp, Homo sapian
  CDS (394)...(1866)
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtattggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 53 - protein, 490 aa, Homo sapian; identical to SEQ ID NO: 13

SEQ ID NO: 54 - DNA, 6857 bp, Homo sapian
  CDS (394)...(1866)
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgataaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 55 - protein, 490 aa, Homo sapian; identical to SEQ ID NO: 17

SEQ ID NO: 56 - DNA, 6857 bp, Homo sapian
  CDS (394)...(1866)
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcctccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 57 - protein, 490 aa, Homo sapian; identical to SEQ ID NO: 17

SEQ ID NO: 58 - DNA, 6857 bp, Homo sapian
  CDS (394)...(1866)
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcatgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 59 - protein, 490 aa, Homo sapian; identical to SEQ ID NO: 17

SEQ ID NO: 60 - DNA, 6857 bp, Homo sapian
  CDS (394)...(1866)
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaacaaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 61 - protein, 490 aa, Homo sapian; identical to SEQ ID NO: 17

SEQ ID NO: 62 - DNA, 6857 bp, Homo sapian
  CDS (394)...(1866)
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctgaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 63 - protein, 490 aa, Homo sapian; identical to SEQ ID NO: 17

SEQ ID NO: 64 - DNA, 6857 bp, Homo sapian
  CDS (394)...(1866)
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctacaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 65 - protein, 490 aa, Homo sapian; identical to SEQ ID NO: 17

SEQ ID NO: 66 - DNA, 6857 bp, Homo sapian
  CDS (394)...(1866)
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactgtcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 67 - protein, 490 aa, Homo sapian; identical to SEQ ID NO: 17

SEQ ID NO: 68 - DNA, 6857 bp, Homo sapian
  CDS (394)...(1866)
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatctttttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 69 - protein, 490 aa, Homo sapian; identical to SEQ ID NO: 17

SEQ ID NO: 70 - DNA, 6857 bp, Homo sapian
  CDS (394)...(1866)
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttcccccaaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 71 - protein, 490 aa, Homo sapian; identical to SEQ ID NO: 17

SEQ ID NO: 72 - DNA, 6857 bp, Homo sapian
  CDS (394)...(1866)
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttcccccgaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 73 - protein, 490 aa, Homo sapian; identical to SEQ ID NO: 17

SEQ ID NO: 74 - DNA, 6857 bp, Homo sapian
  CDS (394)...(1866)
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccctaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 75 - protein, 490 aa, Homo sapian; identical to SEQ ID NO: 17

SEQ ID NO: 76 - DNA, 6857 bp, Homo sapian
  CDS (394)...(1866)
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaataagtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 77 - protein, 490 aa, Homo sapian; identical to SEQ ID NO: 17

SEQ ID NO: 78 - protein, 454 aa, Homo sapian; identical to SEQ ID NO: 3

SEQ ID NO: 79 - protein, 45 aa, Homo sapian
SGSPGLQALSLSLSSGFTPFSCLSLPSSWDYRCPPPCPADFFLYF

SEQ ID NO: 80 - protein, 419 aa, Homo sapian [sequence omitted]

SEQ ID NO: 81 - protein, 490 aa, Homo sapian; identical to SEQ ID NO: 13

SEQ ID NO: 82 - protein, 576 aa, Homo sapian; identical to SEQ ID NO: 15

SEQ ID NO: 83 - protein, 490 aa, Homo sapian; identical to SEQ ID NO: 17

SEQ ID NO: 84 - protein, 454 aa, Homo sapian; identical to SEQ ID NO: 27

SEQ ID NO: 85 - protein, 454 aa, Homo sapian
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTFWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILDLLQLCRYPD

SEQ ID NO: 86 - protein, 576 aa, Homo sapian; identical to SEQ ID NO: 43

SEQ ID NO: 87 - protein, 490 aa, Homo sapian; identical to SEQ ID NO: 51

SEQ ID NO: 88 - protein, 444 aa, Homo sapian
MESISMMGSPKSLSETCLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVIL

SEQ ID NO: 89 - protein, 444 aa, Homo sapian
MESISMMGSPKSLSETCLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTFWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVIL

SEQ ID NO: 90 - protein, 444 aa, Homo sapian; identical to SEQ ID NO: 88

SEQ ID NO: 91 - protein, 444 aa, Homo sapian
MESISMMGSPKSLSETVLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVIL

SEQ ID NO: 92 - protein, 444 aa, Homo sapian; identical to SEQ ID NO: 88

SEQ ID NO: 93 - protein, 443 aa, Homo sapian
MESISMMGSPKSLETFLPNGINGIKDARQVTVGVIGSGDFAKSLTIRLIRCGYHVVIGSRNPKFASEFFPHVVDVTHHEDALTKTNIIFVAIHREHYTSLWDLRHLLVGKILIDVSNNMRVNQYPESNAEYLASLFPDSLIVKGFNVISAWALQLGPKDASRQVYICSNNIQARQQVIELARQLNFIPVDLGSLSSAKEIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLDTWLQCRKQLGLLSFFFAVVHVAYSLCLPMRRSERYLFLNMAYQQVHANIENAWNEEEVWRIEMYISFGIMSLGLLSLLAVTSIPSVSNALNWREFSFIQSTLGYVALLITTFHVLIYGWKRAFAEEYYRFYTPPNFVLALVLPSIVIL

SEQ ID NO: 94 - protein, 316 aa, Homo sapian
FITSTLQNITSTSIIFLLTGVPGLEAFHTWISIPFCFLSVTALLGNSLILFATITQPSLHEPMYYFLSMLSATDLGLSISTLVTMLSIFWFNVREISFNACLSHMFFIKFFTVMESSVLLAMAFDRFVAVSNPLRYAMILTDSRIAQIGVASVIRGLLMLTPMVALLIRLSYCHSQVLHHSYCYHPDVMKLSCTDTRINSAVGLTAMFSTVGVDLLLILLSYVLIIRTVLSVASPEERKETFSTCVSHIVAFAIYYIPLISLSIVHRFGKQAPAYVHTMIANTYLLISPLMNPVIYSVKTKQIRRAVIKILHSKET

SEQ ID NO: 95 - protein, 254 aa, Homo sapian
MYYFLSMLSATDLGLSISTLVTMLSIFWFNVREISFNACLSHMFFIKFFTVMESSVLLAMAFDRFVAVSNPLRYAMILTDSRIAQIGVASVIRGLLMLTPMVALLIRLSYCHSQVLHHSYCYHPDVMKLSCTDTRINSAVGLTAMFSTVGVDLLLILLSYVLIIRTVLSVASPEERKETFSTCVSHIVAFAIYYIPLISLSIVHRFGKQAPAYVHTMIANTYLLISPLMNPVIYSVKTKQIRRAVIKILHSKET

SEQ ID NO: 96 - protein, 254 aa, Homo sapian
MYYFLSMLSATDLGLSISTLVTMLSIFWFNVREISFNACLSHMFFIKFFTVMESSVLLAMAFDRFVAVSNPLRYAMILTDSRIAQIGVASVIRGLLMLTPMVALLIRLSYCHSQVLHHSYCYHPDVMKLSCTDTRINSAVGLTAMFSTVGVDLLLILLSYVLIIRTVLSVASPEERKETFSTCVSHIVAFAIYYIPLISLSIVHRFGKQAPAYVHTMIANTYLLTSPLMNPVIYSVKTKQIRRAVIKILHSKET

SEQ ID NO: 97 - protein, 14 aa, Tetanus toxoid
QYIKANSKFIGITE

SEQ ID NO: 98 - protein, 21 aa, Plasmodium falciparum
DIEKKIAKMEKASSVFNVVNS

SEQ ID NO: 99 - protein, 16 aa, Streptococcus
GAVDSILGGVATYGAA

SEQ ID NO: 100 - protein, 13 aa, Artificial Sequence
  PAN DR-binding Epitope
  VARIANT 3: X = cyclohexylalanine, phenylalanine, or tyrosine
  VARIANT 1, 13: X = D-alanine or L-alanine
XKXVAAWTLKAAX

SEQ ID NO: 101 - DNA, 14 bp, Artificial Sequence
  cDNA synthesis primer
ttttgatcaagctt

SEQ ID NO: 102 - DNA, 42 bp, Artificial Sequence
  Primer
ctaatacgactcactatagggctcgagcggccgcccgggcag

SEQ ID NO: 103 - DNA, 12 bp, Artificial Sequence
  Primer
gatcctgcccgg

SEQ ID NO: 104 - DNA, 40 bp, Artificial Sequence
  Primer
gtaatacgactcactatagggcagcgtggtcgcggccgag

SEQ ID NO: 105 - DNA, 10 bp, Artificial Sequence
  Primer
gatcctcggc

SEQ ID NO: 106 - DNA, 22 bp, Artificial Sequence
  Primer
ctaatacgactcactatagggc

SEQ ID NO: 107 - DNA, 22 bp, Artificial Sequence
  Nested Primer
tcgagcggccgcccgggcagga

SEQ ID NO: 108 - DNA, 20 bp, Artificial Sequence
  Nested Primer
agcgtggtcgcggccgagga

SEQ ID NO: 109 - DNA, 25 bp, Artificial Sequence
  Primer
atatcgccgcgctcgtcgtcgacaa

SEQ ID NO: 110 - DNA, 26 bp, Artificial Sequence
  Primer
agccacacgcagctcattgtagaagg

SEQ ID NO: 111 - DNA, 24 bp, Artificial Sequence
  RT-PCR Primer
gactgagctggaactggaatttgt

SEQ ID NO: 112 - DNA, 24 bp, Artificial Sequence
  RT-PCR Primer
tttgaggagacttcatctcactgg

SEQ ID NO: 113 - DNA, 24 bp, Artificial Sequence
  Epitope Tag
gattacaaggatgacgacgataag

SEQ ID NO: 114 - protein, 4 aa, Homo sapian
RKET

SEQ ID NO: 115 - protein, 4 aa, Homo sapian
SATD

SEQ ID NO: 116 - protein, 4 aa, Homo sapian
TVME

SEQ ID NO: 117 - protein, 4 aa, Homo sapian
SCTD

SEQ ID NO: 118 - protein, 4 aa, Homo sapian
SPEE

SEQ ID NO: 119 - protein, 6 aa, Homo sapian
GLSIST

SEQ ID NO: 120 - protein, 17 aa, Homo sapian
MESSVLLAMAFDRFVAV

SEQ ID NO: 121 - protein, 454 aa, Homo sapian; identical to SEQ ID NO: 3

SEQ ID NO: 122 - protein, 45 aa, Homo sapian; identical to SEQ ID NO: 79

SEQ ID NO: 123 - protein, 17 aa, Homo sapian
NLPLRLFTFWRGPVVVA

SEQ ID NO: 124 - protein, 19 aa, Homo sapian
ENLPLRLFTFWRGPVVVAI

SEQ ID NO: 125 - protein, 29 aa, Homo sapian
SAREIENLPLRLFTFWRGPVVVAISLATF

SEQ ID NO: 126 - protein, 32 aa, Homo sapian
WREFSFIQIFCSFADTQTELELEFVFLLTLLL

SEQ ID NO: 127 - protein, 33 aa, Homo sapian
NWREFSFIQIFCSFADTQTELELEFVFLLTLLL

SEQ ID NO: 128 - protein, 38 aa, Homo sapian
VSNALNWREFSFIQIFCSFADTQTELELEFVFLLTLLL

SEQ ID NO: 129 - protein, 54 aa, Homo sapian
VLPSIVILGKIILFLPCISRKLKRIKKGWEKSQFLEEGIGGTIPHVSPERVTVM

SEQ ID NO: 130 - protein, 55 aa, Homo sapian
LVLPSIVILGKIILFLPCISRKLKRIKKGWEKSQFLEEGIGGTIPHVSPERVTVM

SEQ ID NO: 131 - protein, 60 aa, Homo sapian
NFVLALVLPSIVILGKIILFLPCISRKLKRIKKGWEKSQFLEEGIGGTIPHVSPERVTVM

SEQ ID NO: 132 - protein, 17 aa, Homo sapian
FLNMAYQQSTLGYVALL

SEQ ID NO: 133 - protein, 19 aa, Homo sapian
LFLNMAYQQSTLGYVALLI

SEQ ID NO: 134 - protein, 29 aa, Homo sapian
RSERYLFLNMAYQQSTLGYVALLISTFHV

SEQ ID NO: 135 - protein, 193 aa, Homo sapian
PSIVILDLSVEVLASPAAAWKCLGANILRGGLSEIVLPIEWQQDRKIPPLSTPPPPAMWTEEAGATAEAQESGIRNKSSSSSQIPVVGVVTEDDEAQDSIDPPESPDRALKAANSWRNPVLPHTNGVGPLWEFLLRLLKSQAASGTLSLAFTSWSLGEFLGSGTWMKLETIILSKLTQEQKSKHCMFSLISGS

SEQ ID NO: 136 - protein, 194 aa, Homo sapian
LPSIVILDLSVEVLASPAAAWKCLGANILRGGLSEIVLPIEWQQDRKIPPLSTPPPPAMWTEEAGATAEAQESGIRNKSSSSSQIPVVGVVTEDDEAQDSIDPPESPDRALKAANSWRNPVLPHTNGVGPLWEFLLRLLKSQAASGTLSLAFTSWSLGEFLGSGTWMKLETIILSKLTQEQKSKHCMFSLISGS

SEQ ID NO: 137 - protein, 199 aa, Homo sapian
VLALVLPSIVILDLSVEVLASPAAAWKCLGANILRGGLSEIVLPIEWQQDRKIPPLSTPPPPAMWTEEAGATAEAQESGIRNKSSSSSQIPVVGVVTEDDEAQDSIDPPESPDRALKAANSWRNPVLPHTNGVGPLWEFLLRLLKSQAASGTLSLAFTSWSLGEFLGSGTWMKLETIILSKLTQEQKSKHCMFSLISGS

SEQ ID NO: 138 - protein, 17 aa, Homo sapian
KSQFLEEGMGGTIPHVS

SEQ ID NO: 139 - protein, 19 aa, Homo sapian
EKSQFLEEGMGGTIPHVSP

SEQ ID NO: 140 - protein, 29 aa, Homo sapian
IKKGWEKSQFLEEGMGGTIPHVSPERVTV

SEQ ID NO: 141 - protein, 17 aa, Homo sapian
SPKSLSETFLPNGINGI

SEQ ID NO: 142 - protein, 19 aa, Homo sapian
GSPKSLSETFLPNGINGIK

SEQ ID NO: 143 - protein, 29 aa, Homo sapian
SISMMGSPKSLSETFLPNGINGIKDARKV

SEQ ID NO: 144 - protein, 17 aa, Homo sapian
NLPLRLFTFWRGPVVVA

SEQ ID NO: 145 - protein, 19 aa, Homo sapian
ENLPLRLFTFWRGPVVVAI

SEQ ID NO: 146 - protein, 29 aa, Homo sapian
SAREIENLPLRLFTFWRGPVVVAISLATF

SEQ ID NO: 147 - protein, 17 aa, Homo sapian
SKLTQEQKTKHCMFSLI

SEQ ID NO: 148 - protein, 19 aa, Homo sapian
LSKLTQEQKTKHCMFSLIS

SEQ ID NO: 149 - protein, 26 aa, Homo sapian
LETIILSKLTQEQKTKHCMFSLISGS

SEQ ID NO: 150 - protein, 17 aa, Homo sapian
ILFLPCISQKLKRIKKG

SEQ ID NO: 151 - protein, 19 aa, Homo sapian
IILFLPCISQKLKRIKKGW

SEQ ID NO: 152 - protein, 29 aa, Homo sapian
VILGKIILFLPCISQKLKRIKKGWEKSQF

SEQ ID NO: 153 - DNA, 3041 bp, Homo sapian; identical to SEQ ID NO: 4

SEQ ID NO: 154 - DNA, 2453 bp, Homo sapian; identical to SEQ ID NO: 2

SEQ ID NO: 155 - DNA, 3041 bp, Homo sapian; identical to SEQ ID NO: 4

SEQ ID NO: 156 - protein, 45 aa, Homo sapian; identical to SEQ ID NO: 79

SEQ ID NO: 157 - DNA, 2280 bp, Homo sapian; identical to SEQ ID NO: 6

SEQ ID NO: 158 - DNA, 2453 bp, Homo sapian; identical to SEQ ID NO: 2

SEQ ID NO: 159 - DNA, 2280 bp, Homo sapian; identical to SEQ ID NO: 6

SEQ ID NO: 160 - protein, 454 aa, Homo sapian; identical to SEQ ID NO: 3

SEQ ID NO: 161 - protein, 454 aa, Homo sapian; identical to SEQ ID NO: 3

SEQ ID NO: 162 - protein, 454 aa, Homo sapian; identical to SEQ ID NO: 3

SEQ ID NO: 163 - DNA, 2374 bp, Homo sapian; identical to SEQ ID NO: 8

SEQ ID NO: 164 - DNA, 2453 bp, Homo sapian; identical to SEQ ID NO: 2

SEQ ID NO: 165 - DNA, 2374 bp, Homo sapian; identical to SEQ ID NO: 8

SEQ ID NO: 166 - protein, 454 aa, Homo sapian; identical to SEQ ID NO: 3

SEQ ID NO: 167 - protein, 454 aa, Homo sapian; identical to SEQ ID NO: 3

SEQ ID NO: 168 - protein, 454 aa, Homo sapian; identical to SEQ ID NO: 3

SEQ ID NO: 169 - DNA, 2249 bp, Homo sapian; identical to SEQ ID NO: 10

SEQ ID NO: 170 - DNA, 2453 bp, Homo sapian; identical to SEQ ID NO: 2

SEQ ID NO: 171 - DNA, 2249 bp, Homo sapian; identical to SEQ ID NO: 10

SEQ ID NO: 172 - protein, 419 aa, Homo sapian [sequence omitted]

SEQ ID NO: 173 - protein, 454 aa, Homo sapian; identical to SEQ ID NO: 3

SEQ ID NO: 174 - protein, 419 aa, Homo sapian [sequence omitted]

SEQ ID NO: 175 - DNA, 3754 bp, Homo sapian; identical to SEQ ID NO: 12

SEQ ID NO: 176 - DNA, 2453 bp, Homo sapian; identical to SEQ ID NO: 2

SEQ ID NO: 177 - DNA, 3754 bp, Homo sapian; identical to SEQ ID NO: 12

SEQ ID NO: 178 - protein, 490 aa, Homo sapian; identical to SEQ ID NO: 13

SEQ ID NO: 179 - protein, 454 aa, Homo sapian; identical to SEQ ID NO: 3

SEQ ID NO: 180 - protein, 490 aa, Homo sapian; identical to SEQ ID NO: 13

SEQ ID NO: 181 - DNA, 2192 bp, Homo sapian; identical to SEQ ID NO: 14

SEQ ID NO: 182 - DNA, 2453 bp, Homo sapian; identical to SEQ ID NO: 2

SEQ ID NO: 183 - DNA, 2192 bp, Homo sapian; identical to SEQ ID NO: 14

SEQ ID NO: 184 - protein, 576 aa, Homo sapian; identical to SEQ ID NO: 15

SEQ ID NO: 185 - protein, 454 aa, Homo sapian; identical to SEQ ID NO: 3

SEQ ID NO: 186 - protein, 576 aa, Homo sapian; identical to SEQ ID NO: 15

SEQ ID NO: 187 - DNA, 6857 bp, Homo sapian; identical to SEQ ID NO: 16

SEQ ID NO: 188 - DNA, 2453 bp, Homo sapian; identical to SEQ ID NO: 2

SEQ ID NO: 189 - DNA, 6857 bp, Homo sapian; identical to SEQ ID NO: 16

SEQ ID NO: 190 - protein, 490 aa, Homo sapian; identical to SEQ ID NO: 17

SEQ ID NO: 191 - protein, 454 aa, Homo sapian; identical to SEQ ID NO: 3

SEQ ID NO: 192 - protein, 490 aa, Homo sapian; identical to SEQ ID NO: 17

SEQ ID NO: 193 - protein, 454 aa, Homo sapian; identical to SEQ ID NO: 3

SEQ ID NO: 194 - protein, 45 aa, Homo sapian; identical to SEQ ID NO: 79

SEQ ID NO: 195 - protein, 419 aa, Homo sapian [sequence omitted]

SEQ ID NO: 196 - protein, 490 aa, Homo sapian; identical to SEQ ID NO: 13

SEQ ID NO: 197 - protein, 576 aa, Homo sapian; identical to SEQ ID NO: 15

The invention claimed is:

1. A composition comprising an isolated polynucleotide that encodes an antibody or fragment thereof which immunospecifically binds to a protein having the amino acid sequence of SEQ ID NO:3.

2. A composition of claim 1, further comprising a physiologically acceptable carrier.

3. A pharmaceutical composition that comprises the composition of claim 1 in a human unit dose form.

4. A composition of claim 1, wherein the antibody is a monoclonal antibody.

5. A composition of claim 1, wherein the antibody is a humanized antibody.

6. A composition of claim 1, wherein the antibody is a human antibody.

* * * * *